United States Patent 10,233,495 (METHODS AND COMPOSITIONS FOR SCREENING AND TREATING DEVELOPMENTAL DISORDERS) - sequence listing, part 132

SEQ ID NO: 621 - DNA, 117792996 bp, Homo sapiens (residues 116,110,303-117,792,996 of 117,792,996)
  misc_feature (358797)..(383796): n is a, c, g, or t
  misc_feature (12480561)..(12530560): n is a, c, g, or t
  misc_feature (13211533)..(13391532): n is a, c, g, or t
  misc_feature (15763259)..(15813258): n is a, c, g, or t
  misc_feature (21949357)..(24949356): n is a, c, g, or t
  misc_feature (39920968)..(39940967): n is a, c, g, or t
  misc_feature (76754544)..(76824543): n is a, c, g, or t
  misc_feature (78946938)..(78966937): n is a, c, g, or t
  misc_feature (106685630)..(106715629): n is a, c, g, or t
  misc_feature (112143340)..(112183339): n is a, c, g, or t
acagagcaagactctgttaaaaaaaaaaaaagacatttatggacattctaatattaaatcaccttgctttactgacattcgctgaacttggtcattattggctattttcctttatacacatttggatttggtttagaaaaatttttgtgagagtggggacgtccagcttcggagcgggaatcttcgctgcgccagcgactaaaaggagaattaaatatgggtgatgttgagaaaggcaagaagatttttattatgaagtgttcccagtgccacaccgttgaaaagggaggcaagcacaagactgggccaaatctccaaggcctcttcgggcggaagacaggtcaggccgctggatactcttacacggttgccagtaagaacaaaggcatcacctggggagaggatacactgatggagtatttggagaatcccaagaagcacatacctgaaacaaaaatgatctttgtcggcattaagaagaaggaagaaagggcagactcgatagcttttctcaaaaaagctactaatgagtaataattggccactgccttgtttattacaaaacagaaatgtctcatgacttttgtatgcataccatcctttaatagatctcatacaccagaattcagatcatgaatgactgacagaatattttgttgagcagtcctgatttaaaactaagactggtttgtggttaaatgaatacgttcagttcttgaattttaatagtaactccaattcagtaaatgctatcactgtttaccccttctaaagatatgattagacttcgttagtaatgttcaacttttcacaaagatggtgagtgccgtcttaaaacttactggagattggttttatatttagatttatatgactggttatgtgaatatatgtaaatactggggaaattccttcactgtcttagaaccaagcaagattcacctgtgttttgtgttcatttgcctcttaaaggcaacggttgaaggtaaataagggagcaatgtctatagttttggccttaactatgccaatctaattagaattccctgcattaaaaaaaaaaaagaaaaatttttgtttaggacttttgtctctgtattccagaccaaaatggacctacaatcttcctatcttgttctgtttttgcctagttaatattaaggttttgttgggtaatggtccttccttttcaattctctggcagagtctgtagagttgctagaacttgtctgtaaaaccatgcgggccggctgttttatttgtgggaagatttttaaaccgctgcttcaatctgttttatacttttagggttactagggctcgcttgcttgctttttttttttttttttttttgagacggagtctcactctgtcacctaggctagagtgcagtggcgtggcatgatctcggctcactgcaacctccacctcccaggttcaagtgattctcctgtctcagcctcccgagtaggtgggattacaggcacccaccaccacgcccggctaatttttgtatttttagtagagacggggtttcaccatgttggccaggctggtctcaaactcctgacctcaagtgatccacccgcctcggcctcccaaagtgctgggattacaggtgtgagccaccatgcccggcctttttttgtctgttttagtaaatttagtatatttctactttgtttcaggtttattgtcatcagtagttggtggtttatttttagtccttaaactgtctgtatacattttctgtattttcatataattcacaattttaaaggcaaaattaaaaaaaacaataggccgggcatggtggctcacgcctgtaatcccagcactttgggaggccgaggcgggcggatcacctgaggtcaggagttcgagaccagcctggccaacatagtgaaaccccgtctctactaaaaatacaaaaattagctgggcgtggtggtgcgcatctgtggtcccagctactcaggaggctgaggcaggagaatcccttgaaccgggaggcggaggctgcagtgagccgagattacaccactgcactccagccttggtgacagagactctgtctcaaaaaaaaaaaaaaaaaaaaaaaaaaaggtaatcacattacccactttaaagcatacatacaattcggtggttgttagtatactcacaatgttgtgccaccatcactaataattccagaacattttcatcaccccaaaaagaaaccccttacttgttagcaatcaatctccgttcccccctcctctagcccctggcaaccattcatctccttgctgtctctatggatttgcctattctgatcttttatatgaatggaatcatacgctatgtggccttttgtgtgtagcttctttcactcagcacaatgcttccaaggctcatctgtgttgtggcatggatcagtattttatttctttttatgcctgaatagtatatcaaatgatgagaccaaatcattgtactgttcttgcaacttttctgtaggtttttacattttcaaagtaagaagttgaaaagaaaaaacttatcttaagcaatcattggattaaagaggagagcatacagaagcgacaagcttcgagagcatcgtgaaaagaagaacacgtcttaccccaacctctacacacaactcaagctttccacgaggggcagttagaatagtcaagatatgcatgattaaggaggatagatcaaaagtcaacgacaaccagaaaaagaatgagagaagccaaaggggaaacaaaggaagggggaaaaagagaataaagattaaaaacataaaatagtaaaaattgtaaataaatacaaaagctgattctttaacaacagaaaaaaattgataatttcctaacaaaatataactttctgaaaacccaacaagaactagaaaatttgagtctacaaattaccattttaaagtagagaaggaagccaaactcagtagctcacgcctgtaatcccaacagtttgggaggccaaggtgggaggatcacttgagtctaggagtttgaggccagcctgagcaatatagtgagactcccatctctacaaaaacaaaaattaaaaaattagctggacgtggtggcacacacctgtagtcctagctgctcaggagggtgaggtgagaggatcgcttgagcccaggaatttgaggctgcactgagctacagtcatgccactgtactccagccctggcaatggagggagaccctgtgtcaaataaaataaaatagagaggggattctccataaaaacagtaccaaccctaagtagtttcaaagccaagtcctatataatctttcaagacaaaataattctgatatcatttaaactattccagtccacacaaaaacatttcataaagccaacaatacctaaacctaggttgatgcccaaacctcctaaacagagtacaaaaagaaacctgtgaacaactgtcacttctgattacaaatgcaaaaattataaataaaagataagcacatggattccagcgatatagcaaaagaataagacattatgtctgagcaagacataatattctattattatgaatagaatagaatttcgggtctactccagaaatacagaggtgattgaacatcaggaaatctttccacagaattcattactcagcaaattaaaggaggaaactcacaggatcactagttgctgactaggcatttgatgcatttcgacaggcgttccttgaaaaagaaagaacatctcttctaaaaggatactgggtagaaacacgtaaaggtggtagtgagagacagcatttccactcttctgcatagcaacacaaaagcaacggggtgcatggaaaccccctgccaactccattgttggccaaaggaggagtcagacagcctcctagcaagcaaagcagaaatctttcccaagccccaggtcctgaagatattctcctgttgtcttctacaagctttattgttttgccttttgttcttagatctacaacatacctggaattgatttttttgtgtataatgtcaggcagtggtcaaaatttgttttttctttaaaaaaaaaaaacaaaaagacttccaggctgaagatcctcaagaaggattctgtagggtcttattacaaggtccattttgggtcttgtttttaagcaatgccaggaagctgaccaaagtactctcttcctttaaaagcaacagtgcattgagatgcatctccctttgagggcagaggcatttgcttacacatatcggaacttgggcacttttacattgcaagggagccattggcaattctctggtcccatcacaattgcctgctggagaaaatgcacagtgtgaacccctggggaggggatattgccaattctatgacttgcacaactcgcaaatcaagtccttcctctcctttcatgccttcatggtctcagtgcccgccctctgcatccttgggacgaggccatgacccaaaggggctgctagggcgctagtcttcttcctttctgtctttgcaatgcctccagtgggttacctgtgatgcacaccgcattctggtttaatgcgtattcaattataaattgttttctttctcttctacttttgtggagaggttttctgggttgggagaagattttgtttttaattaaatttccccaacatactccatagcaatggggaaaggagttgtcccctttccccattgctatggagtatgttggggaaatgtaactcatctgaccaggcactttctcaggcatcagtcccaatcaagttatgttattataacaggtgttgtcctttccccattgctatggagtatgttggggaaatttaattaaaaacaaaagacagaaagggcctcactcttctatacagctaagtgggtctgtatccactacagtaggcaggtttcacaattcggagccaggtggcagctgaaactgagagatgaagagagttatcttcctggatgattaattacatttcgaaaagctggctcccggatcccagaggagaggaaacattcctgagttgtgaaactggccagagcttctttagccattaaaaacatctacatacatttgaaaaggacagagaaagaaattccaaaagataaaggaaaaaggtgcagggagtctcttaccttattttcaacagagagaattaagcctcttgtttttaatctgtatttgcccttacaatcttcttcctgtgttactatgaaataataacattgcgatatttaattaacaccattgttgcttttaccttcttctgggcaagttgcagatgcctaaatatccagctagcccgtagtaaaatgcaaaacaatgaccacaattgcaatagcatcagtttttgaattcagtacaatacttgccttggaggacaaccttcaaatatatcacatcaatggttcagggttcaatcagattctttgtaggcaaatgtgtaaacatttccctccatcacacattaattgtactagctgtcatgacatcttcattgcctgagctttcaaatggctaaccatttgaatattatttcatggctccttacaaaatcttatccaatccaagcttaaggagtagtttaactctggagtcttataaatttttaatgaagagttttccttgtaagacccccagaatttcttgagttttcatcatatatgtgtgtatgtgtatatatatagatagatatatacatatatatacacacatatatagatatatacatatatagatatatacatatatacacatatatatagatatatacatatatacacatatatatacatatatatatgtatacacatatatatgtatatatatgtaactttttttttttttgaggagtcttgctctgttgcccaggctggagtacagtggcacgatctcagctcactgcaacctctacctcctgggttcaaacgattgtcctacctcagcctcctgagtagctggaatgacaggtgcctaccaccaggccaggctggtttcaaactcctggcctcaagtgatccacccactttggcctcctgaagtgctgggattacgagcgtgagccaccatgcctggccctgtaacatcatattgacaataataatgtaggcactttggtaattgttttgtcttcctgagtggtatttctcaatgtgaactacaaagatacctatggccatatctaggatcgaagtcttttttttttttttttttgagacggagtctcgctctgtcacccaagctggagtgcagtggtgtggtctcggctcactgcaagctccgcctcccgggttcacgccattctcctgcctcagcctcccgagtagctgggactacaggcgcctgccaccacgcctggctaattttttgtatttttagtagagacggggtttcaccatgttggccaggatggtctcgatctcctgacctcatgatccgtcagccttggcctcccaacgtgctgggattacaggcgtgagccactgcgcccggcagatcaaagtcttactatgaacttccagggtgtaatgtacacagccctatctgttttttgtttgtttgtttgttttgagatggagctttgctcttgttgcccaggctggagtgcaatggtgtgatctcggctcacagcaacctccgcctcccgggttcaagtgattctcctgcctcagcctcccgagtagctgggattataggcttgcaccaccacgcccggctaatttttgtatttttagtagagacggggtttctccacgttggtcaggctggtttcgaactctcgacctcaggtgatatgcccacctcggcctcccaaagtgctgggattacaggcatgaaccaccgagcccaaactgccctatctgttttaagttgaggaaaactcatcctatcggcactttctcaggcatcagtcccaatcaagttatgttattataacagcctattaagtctccctggataacagacaaccctttgtttatctatccatactgggactggagagaacttacattgtacaattaatgaagtgacactatacctgtcttcgcagcctctgtctatatatgccagctttctatttgtctattgattagatgctgttcttttcatctgttctatagtcatactcccaatatctaattgtttccttaaatatgaatagacctgctaatgatgatattgtagaactgttttgtagctaatcgctgctgggctatgagtgagggcctcctacagcttgatgagattatgtcttcccagcattaaattattccaaacagatcaatttcaaagttaacaaataacatgtttgttagtaaaaatgtgagtcttacagtaattcaaataactactactgtggatagagcagccaatatcagttacaggaaaagtcctttgtggcaaccacaatgcaatcctcccaagagtccagctgcgtttttctttctctccgatggccctgtaggtgatcagtagcatttgaaaacattcctctcagcacagtggcagcccaggcctttcccctggaaaagctttgatgcagaggaaacctcccagtcaactgggatggtggacttctttggagggttacctccagatccttctgactttttaagtctcatggtttctaaagaagagaaaagccctattaagtattgagtatgattacgggaggattcagttaaatcaggcacaggaaggacaggcacagtggctcatgcctgtaatcccagcactttgggaggctgaggcaggtggatcacctgaggccaggagttcaagaccagcctagccaacatggcaaaatcccatctctacaaaaaatacaaaaaaataaaactagccaggtgtggtggcacatgcctgtaatcgcagctacttgggaggctgaggcagaagaatcacttgaatctgggaggcagaagttgcagtgagttaagatcatgccaccgcactccagcctgggcaacagagcaagattctttctcaaaaaataaaaataaataaaaacattaaaaaaaatcagccacaggacttggtcttggacccaagttagagctaggccatgcttgcttaaaggagtggctgtaattttaaacaaggctagtgggaaagttccaggccatcttaacattgtaggttgcagaatcttagccaatgagtctttcagagctggattcattaatctgttaattaattcattaatttttttatgctactggatgacagtaggaataaaatgactttttctgtctgattcaaatgctctggtattccaaaagggagattcatatttattaagagagtctttcccgttgtttatacttcctgcctaaggatcagcttctttttctctttcttcacagctgacaacagatgccctaattgtttcacctcaggttagcactattgcaatttgtctagcaagaccttatgtccccgccagatgagaaattgcagtaaagccaaagcatcagttttgcattgctcttcagtttctgaggctactagtagcaagtcgtctacatagcaaataatcatagatccctctggtgggagaaattcctctaagtgtttctgtaaatgactagagaaaataatgggagcattcaaaacccttgaggaattctttgccataaatatcagactttctcataagcaaaagcaaacaagaatttagattcatctgctagaggaatggaaagacagaaaatgcagaaaattgatcaattacagagaaaaactttgcagacaatggtaccaaagtcagaagagttgctggagtaaacagaacagcacacatatttacttctttaagtttttttttttttttttttttgagacggagtctctctctgccgcccaggctgaggtcagtggtgtgatctcggctcactgcaacctctgccccccgggttcaagtgattctcctgcctcagcatctcaagtagctgggattacaggcacgtgccaccacacccagctaattttttgtatgtttcttagagacagggtttcaccatgttggccaggctggtctcgaacttctgacctcaggtgatctgcctgccttggcctcccaaagtgctgggattgcaggtgtgagacaccatgcccggccttctttaagatcttatacaaataaatttagcagttgaccatcttcatcacttttacctctcttctctttcagaagtgtgagactatttcaaagtggtggctttttcaaattatcccttgtttctctattttttttttttttttttgagacaagatcttgctctgtcgcccaggctggagtgcagtggcaccatctcaactcacagcagcctcaacctcccgggctcaagagatcctcccacctctgcctcctgagtagctagggctagaggcatgcaccacctcgcctcgctaatttttctttctttctttctttctttctttctttctttctttctttctttctttttttttttttttttttttgctttttgtagagacagggtcttgctatgttgcccaggctggtctcaaactcctgggctcaagagatcctcctgcctcgacctcccaaagtgctgggattacaggtgagcccccacatctggcctctaattcttttataacctatttcattccttctaattgagctcccaacaaaggagattgttttacacacagctatggcttatccctttggtaaattgattttatgggttctatagctcaaattaaatcagcatctcgattctctagggctcaaaagatgccttgatttgtgtcagctcaggaagggggcttttccggcactgaatatggtaggcttggaggtgcatggcaggtctctcgccaataggtttacagaagagtcaggaggaaaggggagcacttgctccttaggcaaaggcagagggcccatctgatgggaattggagggaagggaatatgtagaaggctgagtcaagatacaaacaacctgtactgatggaaagcaagagcaagagctttccaaggcaaatgcagaataagtagcaccagtctgtatgagaaaaggcaaggacaggtcagcctggcaaacagtgaccgacatacacacacttaaccctaatctcttcccgccactgccatctcctcaatctatccattttgagccatttgcaaagtatctcctagctgagagttttatcctcctaggcccccacccctgattctcttgttcctgccatcctgcatgccccagtctctttggacaatccctcttccaatgtccttgcttcttgcaatgatgacacgtgtcttgcttcctttcctttctgggttgcccagaacaggagttactccctttcagtaaacagacctgagcagctaacacagagtttttcagtttcttcttttcttctttgactttctctagagtcccaaatactgaatagctgctcctaagcttacattatagtcagtcctgccatcctaccaccttttcccttatttgagttgttgttgttgttgttgtttgttttgtttcttgttttgagacagagttttgctcttgttgcccagggtggagtgcaatggcaccatctctgctcactgcaactgccacctcccagcttcaagcagttctcctgcctcagcctcccgagtagctgggattacaggcctgtgccactatgcccggctaattttgtatttttagtagagatagggtttcaccatgttggtcaagctggtctcaaactcctgaccttaggtgatccacccacctcagcctcccaaagtgctgggattacagcctcccaaagtgctgggattacaggcgtgagccactgcgcccagccatattggcactttttaagccttgtgttttttaatgtcccgttgaccaaagcaaatcacatggccaagcccagatctgagagtgtggaaaaatggactctatctcttgcagggaggagctgaaagttccatcacaaaagggtatgcatccagggatggcaagaatttgaggccatttttgtgatccaaggacagagattgtcctcggacataaaattcaaggctggcagtttttttgttgttgttggcacatcagatataccattgtcttgttttctggcttctgtagtttgtgttgagaagttggctgtcagtcaaactgcataactataaaagtaatcaacccacccaccagctgctttgaatgttttctctttgtctttgctttccctcagttttactatgatgtgcctaggtgtggttttttgtttgttttatcccgctcttggttcacgtgacttctagaaactgacttgatatatttcaccagtttggaaatatttcatccattaactcttcaaatattatctgtgccccattctttctcaccttgtttttctgaactccaattaagcatatattaggtcaagcatggtcgctcatgcctgtaatcccagcactttgggaggctgaggcaggaggatcccttgatcctaggagctcaagaccaacctgggcaacatagtaagacctcatctctacaaaaaaaaaatgaacaaaattagctgggcatgattgcatgtgcctgtagtgctagctactcaggaggctgaggcaggaggattgcttgagctcaggaggtcgaggctgcagtgagtggagattgtgccactgccctccagcctgggtaacacagcaagaccttgtcttaaaaaaaaaaaaaatacacgcacacacacatatatgagaccttctttctgtatcccctatgtttcttacctccttttgcattgtcttttaccacctttttacctctccaagctttagtctggctattttcttctgatttatctttctgtttactatttctctcttcagctcttgtatatcccacccattgagctcctaactttaatttgtatattttatatttctaaatttttcactagattctttttgtagtttcaaattatctgctaaatttctcaattctgtcttttgtttccttgaattattaaatataattattttaaagtctgtatctgataatgccattatttggagtccttgtggctctatttttattatattacttttctaatttcatttttattaaattttcttttctccttatgacatgttttgtttgtttttaagacagggtctcacactgtcacctaggctggagtgcaatcatagctcactgtaacattgaactactgggctcaagcaatccccctgcctcagcctcccaagtgctgggattacaggcatgagccaccatgctgggccttgtcctcgttattttttattgagtgctggacattgtgaatggaaactataaatcatttgaggccaaggacaatgttatcttcctccagagaaaatttacatttgtttctggcaggcagctggggcactagaaatcctgatcaccttaatccaattttcagggattgaaagagctcaaatcttgactacagtcccttaggggacagggatgcagtcctttagagggctattctatttccagtttacacttattcctagacctttgggtttccaacccaaagcacgaggagcttactagggccttcttccttggtgagccctgcactctgacttttgacccctcacctcttaagtctgctaactgttctgctcagcttcttgggccctcagctgtctctgctggaattagcggatggccataggggataagcagccttaaatgctgagctcatctctcagctcatttcctttctcccatatcttggtcccatatgcttcactgcctattatcacttggatattttcaagcaaatattttccctgttttactgagtctgtttagttgttctcagtggaggttgtggttcaaattacttattttgtcattgccagacacagaagtcattcagcactaggttttaggctctatttatattgttgagtctacatataatcttgcttccaagtactgcataacactccctaatgttttatctgcttccttagtcactacaaataatgctaccatgacctttgtcatgcaggccattgctctgtcacccaggttggagtgcagtatcatgaacatggctcactgcagcctcaacctcctggactcaatggatgctcctgcctaagcctctcacgcagctgggaccacaggcataagctaccacacacggcgaatttttgtattttttgcagagatgaagtctcaccatgttgctgaggctggtctcaaactcctgggttcaagtaattctcccacctcagcctcccaaagtgccacgattacaggcgtgagccaccacgcccagccaagaatttttgtgatgtatccccaagagcagaattacagagaattaccaaaattacccaacctagtgtatacttaattgatgagatactgacatattgttctccagaatggttgtgttggtctgtatctccaccagcagtacatgagcgctctctagccacacatccctgccagcatttgctattgcctgcatttctaggtgtgtgtgtatttgtcaatctaatgggtatgaagtgatactgttgttttgatttgcgttcctctgataatcaatgggcttgcacatcttgggtgtggcatgtctgctgctggtgctgccaacacttggtggggcatgtagaactgggcctctgacctccgaggaaggggtgtcatctggcgggttccgagaaggccgaaatgagctggagcctgaaaccactgctgctgctaagggccaactgagactggcgctacagcaacaggaatggaaaacaaacaggaaggagcaagacccttctctccttcccagccttccagtctccctctagtgtcccagttggtggaaactgacaaccagccagaagacaaagaaggaatgtaggttcagagtcccagcgccagcctcacaaagcagagtatggcaccttccccgcccctgcccctttggcttcgcaacatcagttcgaagccttcttgcataatttgaacttccctcagcagtaatgacaactttatgtttctgcctaacaagatccttcatacaaatatgctcctaccctcttctcaagaggggagacataaagtcccaacagtctttgtaatcatctccaaattacagtcacggtattggtgatattaatttctcctttaaataagtcatagtaccacttaactattctgtgacctagaggctaagttgtaaagtttaccatcaaaacaactgctattggccaggtgcaatggctcacgcctgtaatctgagcactttgggaggctgaggcaggaggatagcttgagcccaggagtttgagaccaacctgagcaacacagcaagaccctatctctacaaaatattacagataaaaaaattatccagtgtggtggcgcatgcttgtagtcccagctactcaggaggctgaggcaggagaaccgcttgagcccaggaagcggaggttgcagtgagccaagatcacgccactgcactccagtctgggcaacagagggagattgtctcaaattaagagagagagagagaaagaatcaaagtctgtaagtaccgtttcgtgtcagagaggaggagagatggcagagcctttagggaagactgtgaagatgtactgttggccctgccaggttaaaagaaatgtggtctttgaagtgcaaatacataagcttttcaaacctgagcaataaaagaaagtgctctggtggtcttttctctggtgttactatttgacagggcagtagcaagctagacgcaggggctatgacgctttgcttcagtaaagtgactgcgtctgaaacagcagctgcaatcaattcacctgcggtcattcttgaagagccatccaccttctgccaagcaccaaatagacaaatagcatacaagagacatcacgactgcaaccttcaagttcaaggcactaatctctgctatttccctcagaatcgtgacattgggttcctttctctccattaggcaagggttgttctggcatctcactatcattgaatttacgccacagttgagttccagtttaaatcaaccaaccacataggctgttagagtcactttcagctgcatggaccaacattaaatataggccctctggtaaatgcccccagctcaagaaattgtgcccaatccaatgttatatccatcccttttggtagaacatccttagaattcacttccacacatattcgcccaggtttttgccaatatttcttaacgaaaatcatgttattgttctggtgtataggttttcctcttgtgttttagtgtgtacctgtccacctgtggtggattgcaccctcattatgggacagggggtggttgtggtgggttctgagaggagaatgggtatcctcttgcaaggcaccagagggctaccaggtcagccctaaaaattctcttactccttgtacctgcagggctaacagtgctaaatcaaacacaaactttaattgcttgggttacagaatcgcaacgtcagttgattcccagcctcgccacgtgtctcacatgaaatgtcaggcagtggtcgggaggagtgagaccctgaaacttaccattgctttcaagctcaaggacgcaaacaaaccaatctccaaaccccatctttcaggatatgattcttgacaccactccagctgccaattttgctatcagccaggatctgatcaggaagtagaaaggatgacagctcctcccttggtgcatgcagttgagatttcaagtgatcttcctgccttggcctcctgagtagctgggactacaggcatgtgccaccacaccaggctacgttttgtattttttgtagacgaatgtctcgaactcctgggctcaagtgatcctcccagctcagcctcccaaagtgcaggcactgcaggtgtgagtcacagcacccagcctcctctgtttgaagagtcctaactcccttcgttccccagcctgaggggctgtgttaatttcctggagctgccatagcaaagtgccacaaaccaagtggcttcgacagcagaaatggattctctcacagttctgcagggaagaagcccgagatcaaggctgtgagagagcaggaggatcacttgagcctgggagtttgaggttgcagtgaaccatgactgtcccactgcactccagtctgggcaacagaggagattctgtcgaaagaaagagagagagagagagagagaaaaaggaaggtaggaaagaaggaaggaaggaagggagggagggagggagggagggaggggaaagaaataagaaaagaagagagagagaaagagaaaggaaggaaggagagagagaaagaaaggaaggaagaaaagataagaaagaaaaaggaaaggaaagaaagaaggaaggaagaaaagaaagaaagagagaaagagaaaaggaaggagagagagaaaggaagaagaaaagagaaagaaagaagaaaaaagaaagaagaaagaaaacagaaagaaagaaaaagaaagaaagagaaagaaagaagaaaaggaaggaagggaagaaaggaaggaaggaaggaacaaaggaaggggaagaaagggagggaaggaaggaaggaaggaagttggttagagagaggcccacagagctgaagctgggtctctgaggtctgaggtgggggcgtggcctagctagttgtggaggagtgagctcagtagagggacttgtggggctgggatccagacctctaaggagcaggggtctggctgatgctggggtctctgagctcaggggatggcctagtactcagattttggagcatagggcactgggtgtccggtggtggtgtctcagaggtgggatgcaatgaagctggtcttgcaagtgttgagagatctgaaaattggcttcaggcagtgccacggaaatgaagcacttgctgcaagggtgaagaagccttgttagatggtgcgcccaggaaggagcaggtcccttcttcctcctccagtcttgtgggctcccttaaacgcccccagctagcagagcctaggagggaggcgctggtaaagcaggagcatcaccaagcagaggacagcaaagggggtggcacgcccactccacaagccagcactgctccttctagggcacggatctcagagaaaggactgcatatgcccactttatccatgatggctaccattggaaacaacccacacgtccatcaacgggggaatgggtaagtgagtcgcggtgcatgcgtgcatacaatggctactagtcagcatcacagagggaagaagggacacagacgtcaacctggatgagtctcatggaagtgattccagaaagaagccggcacaaagggctccagagcgtgtgcttccatttccatacccgtcaggagcaggcgagaccatctacagccatagacggcaggacagggcttagatctgcagccagggattggctgcctggaggcacaaaagcattctctgtggtgatgcaaatgttctttagttggtccaagttgtggctgcatgtgtggataggcaggtgaaaaaaccaggcgtgcacttgattttctgcacagtaatcctcaataaggacttgtttcacggatttttagggcagtggagttactctgtatgatactgtaagggtggatccatgtcattatacctttgtccaaacccataaatggacaacaccagagtgaaccccgatgtcagctatgggctttagttcatgcgagcttctcactgtggctcaccaattgtaacaaacgtactacactgactcgaaatgttcatcatggggaggcgtaaggggagtgacggggtctgtgggaactccttactttccgctcaatttttctgcaaacctaaaattgctctaaaaagcaaaatgccttaattttttaaaaacccaggaaagcagcccagggccgatgtggcagctccaggtgctcaggccctcgggctgcctttgttgctgttccgccatcctcaacgtgcgacttccctttggtgcgacaaggtagctctccccatgatcacagatcacatttgcctttcagctgtaaggagacagaaagtggctggcacaaggccatgcgtggtggctcacgcctgtaatcccagcagtctcggatgccaaggcgggcagatcacctgagatcagtagttcgagaccagcctggccaacgtggcaaaaccctgtctctactaaaaatacaaaaataagctgggtgtggtggcgggcgcctgtggtcccagctactctggaggctgaggcaggagaatcacttgaacctgggaggcagagggtgccgtgagccaagatcatgccactgcactctagcctgggtgatcgagcgagactccatctcaaaaaagaaaaaaagaaagaaagaaagaaaggaaggaaggaaggaaggaaggaaggaaggaaggaagggaaggaaggaaggaagggaaggaaggaaggaagaaaggcgccagcacaggtttgccctgcaggtatgggtgcactcatgccccaccaccctactgggtgcatagaggctgggaaatgggtcttcagctgagctgccatgtccccaagccacaaatctagtgttatggaagaacagaaaaacagatattggagggcaataagtggacgctgttacaggtggggatcaagggggacaatgagtgtagaggagtcttgaggggttttgctgtaaacaggagcagtgaaacggggcaagagccagggggcatgcggaggcaggagcgggagcttccggtgatagaagctccaagggcatgttggtatgctgctgggcctgaccccacagggagagagaaaaattacaggtgcagaaaacaggaggagagagggggtctcaggggtggcagagaccactgcacatggtgggaagtgttcacctgagggggctagggctggggaggggacagatttgatgatgggaactcaaggaaagaaattctcgtcagatgctctcaacttgctcagtgaaacatgaaacaaagttctcaccttgaaagtgcagggcctgggggctgaggggaaggtgtgaggccttggagaaccagggaggaaactctagaattcccaaggaaggctggctctgcctgggtccacttgaggcttgtggtcataaatctaaggtgcttagtcctgggctgggtgtggtggctcacgcctgtaatgccagcactatcgggaggccgaggtgggagaattgcttgagcccaggagttcgaaaccagcctgagcaacatagggagactccatctctacaacaataatttaaagattagccaggcgtggtggcgtgctccagtggtcctagctacttgagaggctgaagccagaggatttcttgagcccgggaagtggagggctcacctgtgctgggttttctttctttctttctttctttctttctttctttctttctttctttctttctttctttcttttttctttctttctttctctttctttccttttctttctctccctccctcccttcctttctttctttcttgcttgctttcttgctttgtctttctctttctttcttctttctttctttctctttccctccctccctccctctctctctctgtctctctctctctttctttctttctctctttccctccctccctccctccctctctctctctctctctctctctctctctctctttctttctttctttctttttctttctttgtctcgctctgtcgcccaggctggagtgcactggtacaatctcaggtcgctgcaacctgatttttttacctgcctatccacacatgcaaccacgactcggaccaaactaaagaacatttgcatcaccacagagaatgcctttgtgcttccaggcaaccaatccccagctacagaggtaagccctgtcctgccatctatggctgtagatggtctcacctgctcctgatcacgccactgcacttcagcctgggagacagagtgagaccctgtctcaaaaaataaataaataaggtgctttgtactggtttagagggctgggtaccccagagagaacgatgccaccggggcacatcatgagtcttccactgagccatggagctgtgtcccttgagacaggggaagaggctcctgccgctggccacactctactctcatgtttgagcagtgaagggcccggccatggtgacagctaagcttggtctcaggaggccagcagaggcgaggatcctgagccccagcaacaatgtgacagcaacacccaaggcagccaacagccaggcctggcagggtgggtggaaggcccgggctctgggaaggggcagggaagcatcaggactgtgtggctgggccacacccgggcccgcctggcaggtcgctcctagcacctcccacagtgtgacgtggacaggggaagtaagtgttccgcgaaataacaaaaggtgctcttgattttcaggttttatttgcctgttataattctgatattatgtacatatatatatatacttttgtttttttgtagagggcttatcagtagaccaagcacaggcatacagggaggctgtggctgctgagcagtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggtgggggcgggaggaggctgaggaagacaactgttcagacgatagggagggcagggctgctaaggggtcctggggggtgggggcggctggaagaggccggccagtgggcagtgggaggaggtgtgcccgccccgcagccaggtagtgacggaggccacttggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatctcgtagtcagtgtcaggctgcaggtcccactgcgtgtaggagctctggttgtagctgacatactgtggcgaaagggaagccccacccttctcttctgccagggagagagggtggcagcaggggtgagtcggagtgccaggcaacccctctggcccagagcccccttccccaccacgccccaaggccccctttcacgcttacctcccaaggctttgaacaagatatggaacctgaagttgcactggccctccttggggacccaggagacgacactgtagttttcacccgctgtggctgagatgttgccaaaatctgagatccctggggggatgcaggggaacgaggagagtgtggcagctgccaggaagtctaaggccctccctcctggacccggctggccggggcctccctgttggcaggtcattcctccagcttaccagacaaggccatagtgcctccttcccgtacgatggcttcaccagggccctctttggtggtggcctgaagctggaagcggtaccgcaggtgggggctgagatcggtcaggttgtgtgtccgaagttcggggtcccgaaggttgaaggacagttgccccttgcccccctcatccactgtggggacagacaggggttggctgtggctgcagctctgccccctccccgtggcccctccacctcccttccctgctggggcggcgcacgcacgggggtggtaggagagcacgtagccggtgagcacgccgttgtggctgagtgggggctgccagcgcagcagcaggctggtgttcgactggcactccaggtgcaacgcctcggggtggccaggcactgcagggcacagaaccgagtggcaggtaggtcctcgcccaggtctggggaggagggcaggggatgaggcgtggggtgcaggactcacctccctctggggtgctgaaggtgaactcgctggcgggccccgatcctcgcccgttaaaggcctgcacctccaggtggtaggagctatagggccgcaagccactgaggatgacactggtggtgttggcgggcaccaccacatggtctttgtggatatgtctcttgctgtgcttcctctgactgccctccctccagtacgtcacctgcacaagcgaacaggagacctcgcaggggcagaaggcacccagcagggcccccagcgcacacccccaccacccttaatggggaccctcctctcaacccaagtcttccaggagagcggctggcaggtggcaaagccccctcaccatcctgtcgctttacctcagtgatcaccctcctgggcccccatgccttcaacccttacattgtatccgcggaggtggcccttgacctgggccaggtccaccggccgccacttgaccagcacggcacttgagttgaggatttcaatgccttccagctcagggattgcctgggggtctggaaaccaccagtgacttggatagagccataggctctcaccccagccctgaggccaggcccaagcccctacacacagagaagacgaattcggatattttatgaggtacagtttgaggaggagaggtgtgtttgcatggtctcaagatctcttcctggactgcttattagttgcaaaggtgaaaatagtagcttatacaaaggagaaaccatggctgggcgtgatggttcacacccgtattcccaacactttgggagacagaggcgagtggaacatttgaggtctggagttcgagaccaacctgatcaacatggtgcaaccgcatctctactaaatacgaaaattagttgggtgtggtggcgcgtgcctgtaatcccagctaatcaggaggctgaggcaggagaatcgcttgaacccgggaggcagaggttgcagtgagccaagaccgctccactgcactccagcctggatgacagagcaagactccatctcaaaaaaaaaaaaaaagaaagaaaagaaaagaaaagaaaaaagaaaagaaaaaaaggagaaaccagaaaaaaaacttgaccgggtacttcaagttaccatctggtcatgttccagattcaaggaaatgaaagaagcagcattggctgatataactggaataccgctgccaattatagaaatgtgaagtgtggggaatttcataacgtcgctctggttatgtaagagaatatcctcatccttaggaaaggcgcacaccaatgctgagaggtgtggacatgggctggggtggaagcaggcgagctcaaccgtgggcgaggggccctgccggatactcacagtcctctccagagtagccgatagtgacctggggctctggtcccttgccctggctgttgacggcctggactttgatctcatagggcacgaaggtggacgtgttggacaccaccaggaaggggtcgctgacaatctgctcctgccagggccctcgtgtcccctgagggcgccactgcacgcggtactgaacctggggggcgttccagtccatccaccggagcggctggaggaggccagcagaagaggagttggttggccaagaacaccagcattctttggcccgccccccagcacaaaccagcatccccagacatcagccccttcctttgcatagccaagggggagcaacagacacccaggtcatggcctcatgtcccccaggcagctcagcccagggactctcaccttccacgtgatgaccatattggtggtctcatttccttcccccttcacatccacagggttcttctctggggctggaaaggaaagtattaacacatcaatgctgcagcctcttttggagagccacgaggaccgagggccaaggaacaaatggctcattctggcaccaagggagtccagccccctcgcgctccccctggaaatttggaagcagaggaacttgggcatggcacctctctaagccctcccttcacagcccggagccccttccaggtggcatgggagtgggtgccaccctgactcacctgcctcaggtgtgaccacagtctcagagaccgggctgggctccccggggccatatttgtttatggcagtaaccctaaaggtgtagtggacatagggcgacagcttgagggtggtagaggtctggttccctggaaccttgcccagactgtaccatttttcaggcgccatttccttgtcctcaaattcaatgtcatattctgccaagaaatgaaccgacaatggagtgatcagcatgtggctttgggggaagggctgtggaggggttgggtacagtctgggtccctgattacccaggccaactggcatctccagattcccatgaggaaccgtgagtccccccaaaccgtgtccccccaggaaggctccaggaggagggaggaccccaggaggggccagggctggcagaagtgacggtggggtggcactgagctcaagcctcttactctcaatgggggcattgtggtcttctgcaggactccaggacacgcgcacctggctctgcgtcagcaggtgcaggtcggacagcaccagccgtggcaccggcccagggctccctgagggtggggagggtcggtgcttgaaagggcccagggatgtgagccccggccttctggagtggaggcttccaccctaggacttacccaccaccaagagctgtgccctactctccaccacatccagttcggtactggccacgcagctgtagttgccctggtcgctgtagtccaggctgtggatgaccaggcgcccatcctctatgaagtacctgcggaggagccgtgtctgtctttcctgccatctgggctcttctcccctcccatccctccctcctgtctccttcccccgctcctgtcagagccttccccatcaaagcaaggacgaggccaagaggtctggacttccagcttttcccactctgccccctttcaccgtcactgtcctcacttgtcactgtccccaagctcctggaggtctcgaccgtccccacgccaggtgatgctgggctgcaaggaggggtcaaaggaggcctggcacgtgaaggtcaccctggaacctttcttctcgattgtgctgcggggcccctgagtgatctgagttgcatctgagggtaatgcgtgcgtggggaagtcactctgttgtcctccagaggcccagaccctccctcccagaggcactgccagccatgtggcaagggttgcctgacctttaaccttcaggttagccatgatggtaacattgttttggtcattggcagccaggcagaagtagcgtccggtgtcattggcctggaggtctcgaatgcccagggtcccattggcataggggaagaagcgttcgtcctgaagcactgttgtcccatcctcgtccagcctggagggagcagggcgggcctggctctgactggctggcctgggctccctgccctccctggctccctggccactgggacacgacactcaccactaccaggacgagacactcaccactgaacactgggcacaggcgctccgaaggccttgcacagaaggtaggcagtgctgccctggacagccatgtacgtctgattgtccgcagtcaggatcttggctggcagctctaggggaggaacagcctcaggagacagggcaggacttgggaccacagctgggccaggagccagggaccctctgcacggcttcctcgggcccccaagagccctgcaaatcttggttccctgctcccagctgaggcccccgccaggctgtgtctctctctgccttcagacactgccctctgcctcagatgcgcctctggtcacagccacccaacttttacgttattccaggcctaactgacagtcacctctccccagaagccttcctggcctagtccccagccttccctgaagttccaggagaggtgccacctgggctggccttggtcacatcctgtggcacagcggtccgctcagtcacagtgacaagacctttcccctcttacatctccctcggctatcgtgaggctgagtgagatggggcgaagggtgtcagcaaggagaaaggtcggcgccagcctggtaggccgaggacacatcagctgccagctgagccactctggtggcctggcccagtgggctgcagggacagactgggagttaggaggtaaggaagggagggcactcacggacaacgtagatgtaggcattggccagcaagagcccgtgccggttgcgggcctcacattgggtcaccattgtgtcactgggctgcacgttgctcaggatcagggcgccacgctgaatccggtacttctggtctttggccagctctgtgcatgcagcaggtgggcccatgggccacagcccggcattgagctgcgttgaggcccttcctcaccctcctcttcctctcccccacagcccccagggctcgccacactccccactcctgcctgaggccctgctcaccctccacagggatcccgttgattctccaggtgacctctggttggggcctgccctggacttggcagtccaggcgggcagtctctcctggcccatatagatggctctggggcttgtgcagccagtacggggcagctgggaggaaggggagagccgccctgagcccgcagccagcagctggctcttgacccggcgcagaccctcccctcccccatgacagtgggcatcacaggccactgtcccaggaggtccataccctccacggtgacatagtacgcatgccgggcactgcccagtgagttctcggccaggcagcggtactcgccatcatcctcctcgcccactttcagcagctgcagggtcttgttgtggttctggtaggtgacacggtcggctggcatggggccactggggcgcagccatttgatggtgggcgtgggactgcccgggaggcaaagggaagagagcagaagggagaaaggacaaggccaatcaccccagccccctataccccgcggtggtctgagctccctgctagggctccgccaccctgccctgccctgccctgccctgggttcccagactcacaagccctcggcgatgcactccaggaccaatggctgcccctgcaaggccaccaggtggctgctggagttggtggggaagagcaggcgcggcttcctgtcaatcatgctgttggctgccaggagaaagtgggtgggtgggctgcccactcttccctccaccccagaattgcaaggctgagggactcgacactccagccagcccccggggcctctgtgtcttcctccattaaggagagtgtcctgtctctgctctcgacgcctgggaaggggtctgggcagggtagaggtgggagccaagctgttcttgaggaagcctggagttgtcagatggacctatggtgggaagggccatgcctgagggtgaaaggagtcagggagagagtgcagagcctctgagactcactggccttgacccggaggtcaatgggttccttctgaatgatggtcctggtgcctgggaagtgggcgtggcagatgtagtctgagtggttgtcggaggtgagcacattggcaaagtagaggttgccgttctggcccatcgtcacccgctcgtcctgcttgatgtgcaagatctctgcagggggcaaggaggccgaagtcatgaccccgtccaggaagacacccccgctaacaccccgaccccacgaggcagccgctcgccggcacccactgctgttcatccagtagatccggagaggctctgcacttgggggagggttgcaaggcagaaccactgactccccttcctccacctccacgggcttcactgtctcctttggccacttgggggcacctagaagggacagacgggctgacactctcctcctggtccagatggtgctaggcaggagaagggaggtgggggcaggggggtggcgggctacaccagggatggacgagggggcgagagggtcaggccagtagaaacttcacagaaaaggaggcagacactctggataccttctggactcatagcagagactagcacttagggaggccagggtgagcaggagaccaggaggccaggaagggttaaccttccacggttctcagctctccctgcccaccctaggaaaggacgggtggggggaggctgaggctgaggtgcagtgatgggggaggggagctgtggagggatgcaggagtcacagacccttccatcatcctgacacagaaaccatggcaacggttcccaaggtaactggaggggtggggaggggagaggagagcgctcaggaagcagaaagctcagggaggatggaatgcaaagggaaaaccccagggaaaaggcgacacagatcaagacagagccgtggagcaagagagaccaagtcggaggtggaggggaggagatggagagccaagtggaaaagccagagaagaggggccctgctaaggagtgcaggtgtagacagagatgactgcagtgactcaggcaggtctgcccagaatcagtcactccccccaccagcccgcccccccctccccccgccaccttcctgctcagccatgaggcaggcaccaggaaagcctgagggagtgaaagggcatgagatgaccggaagtgcaatggagacagagacagggcaaaggaggagactgcacaagaaacaagatgggccaggggagaagctggggtggggtggagggctggcaggacacccaggcccctcgccacgagacaactggctgacagcagcttccagcccacaatcccacacgaactccgggacctgccctccctggtccctgcagcgcctcgcaccctcggccatgagccggatctcatgggacatggcggtgcccagcttattgctggcaaagcagcggtagatgccctggaacctctgagcaaagttgctgttgttgcccgtgatggtgaaggagccagagtggggcgactggtacacggtcacacccagctcttccttgggtttgaagtggacaccatccctcgtccagcggaacctgtgggcggaaaaaggcccagaggcctgaggccctggaacccaacgggggctggaacaggctggagggacaggtgcaagcagccagggcccccaggggatggactgggagatggcgaggacttggggtgattagcaaggtttggggcttctgggcttagaagttaggcagtccagggaggcacaaggccggggtcagtggcaggcaacaggggctgagacggcagagatcactcactgcacttcgggcttgccactggcctcacacttgaggctgatgtcatctgtggggaagacaaccaggcgccgtggagactgttccgtgatgacaggtggctccatcactgaagacagggtggagagagcggtggtgagggtgctgcctggctggtgtcatagcctcagcacctgtcccatcgtgagggaagcagggtccagagcccctggaggccccatggccacagggggacgaacggaggggaagaacaaaagaggcttgtgggacatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgtccttcatctgagaaatccaggcaggcagcaagggagggaatggagagaaatactgacaggcagccccagagtggggcagatggcaggggacatagtaagctcctgcagcccccccgtggagagggaatggcaggagaggaggccctggcagtggcaacaagggggcacacgctgggctggagcagtggcaggtcaagcccagggagatgggacagagagatgcccagggagaggagctccactggatagacacacagggcatgtagcccagaggcagccaggccatgcctccagctctagcagacagggagagagaaattcttgcctttaacaaggagtgtccttgcagccccctggcagggcctggcagggcctgcagaactgaccccacccattcaggatgccttggaaggcaccgtcccctgctccagcctgcttccctcctaatccaattagcacagctgagtgttttcaattaccagggcccagccttcagagccctgctgccccctccccctgaaaactatcccaaaggccctgctgcctctgagtttccatagcctgcggggttggcgccagccctcctcttctccctccttcctcccagacagccaccaagctctctggggcagaggccagagctgctgtcccagccccaggactctgcagagcactggccagggcggcctcgaggaagggagaagagggagggagggagcagcaggctgcctctgaaagctttgtctctgcagaagacctcagtgtgaaggtccagggagggaggagggggctccctggggacactgcagagggccctgagctggggagggagatggtgacagggatgacaggatgcagaaagccaactaggtggaggaagcaggaaaagagacaaagggggctggagtggctggggagggagagatggaagacaggttccaacagggagggccggctgcctgccactgcccactgtgtcgtatcagggtcaagaacaagtgctggtcagtgaccagggcagccttggagctgccatggccttttggcctagttctctctccccactcccatctttctgtagagaatgcacggcttgcattccactgtacagtgttatattgtgtatccacctctgtgtcctctgggtctaaaagcctcactggtgtgtgtttccacctgtgtggcctctcagcggctctgctccttcatccctgcacctgccttgtcttcatgcacctgtgtgcatgtgtccatgtgcatctgtaccaagggagtctgcctggccctggccctccatgtatgtgtctaaggggccagcccctttacctcctccaagccctcactgcctcccaacgccaggtgcctccccagcctctctctcgcagcccctgtcccactgctggcacagacagtcttcccaacccctatccgccaactcgtctctcagtgacactggcctcctccttgtccaggcccagagacaaaggtgtcaaggtgaggctgggaagggactggagcctggtagctcaagagacacaaatgccctcacacatgataccctgtgacatgcccctcacacggcctgacagctacttacaggagaaaacaccatcacggtaacaccccccacacgcaagtgtgtacttacattcagccccactcacacatacacatgacccaatgcaatcaaatgtcgtggtcaaatacctcccgacctccacaagcctggccagtaagtaacagagtgactcacacagtcacccatgtaaggaagtcaaaatcacattcacgaatatctacgctcagtcaatcacaagaacacacagacatacacagtgtatccatgcttaatcacaaccctacggccacactccccaacatccactcacctgcttgtgcccccaacaaatgttacaaccatagacacatgctccagcagccctgcccccacccccaccaaataactacacacaaaaaagggtccagaaggctgctgggctgggaccagggtttttcaagccaccttttcctgtctcagttcagagacagggtgaccaagggcccaggaggggaaagagaaatggggacaagacttgaacacaggcctttgcacaagccagctgagggctggggacgaccccattctcctgctgccacacccctgtggtgggggatggaagcggaggagtcggagtggggcgggcagagatggggcgggctaaggagagcatggaggaggcccaagacctcggggccctgctccaggttcgctgtccctggtgctgaaatcgccccggcggccgcgcctgtccctgtccatggtcctgacacgccccgcaccttctaccctgcccttctctccgggggtacccaacgtcctggctatctcctgcccaccctgtgcccaggaaaggccagggagaggagtcagggtccggaacagggagaaggtgaggaggtagaagataaagaggggcccaacatagcggcgaaggtaggcgcccaggctcccttcagctactcacattcctcggggatctggataagcaggcaggggctgcagaggaggagaggccacacgtaccgcagcgccacgaccatctttcccggcggcaccgcgcagcacagccagccgggctcggttcaggctccggccggaggggaagggggctggtgggcggcttggggcgggagttgggagtgggggcactgggagaggggagaagggaagggaagggtgggggaagagagacgagagaacggaaggacgttagtgactaacatctgggtaagcccgggctcttggccccgccctcagccccgcccccagctggccggcttctccagccctcccctccccatccgcacccctccccaccttggagggagaaatctggaagagatagccctggctgggcctctaggttgccttttattccctctctactctctgtctgcacctttcctgccagctgccttcccagcaccaacttgttgccccatcagctcccctgtgcatggcatgcacatccccgtatgtgtctgcatgtgcaggtgtccgtgggcatgtgtgtggttgtggatctgcaagcagggagtgagctgtatgtgagctggtatttctgtggtgtgtcttctctgggaggggttgcactcatgagtgggtgtgttagtgtgtgtgcctgagggaatcaacacacaagtctgctagctacgtgtgtcttcttgtatgtctttatgtatctgtggggatgaatccctgtatctattatctctgtgtgcacacacatgtagagaagaattcttcttgcagtcacattgctatagctttcagagccaactgatgcctgggtgctgtacagacctaaaaagctaatggggggattgggaagtgggatagagaagggaggaaaggggcccaagatggcagcatttcacaaaatagtttcaggaaaatgaagaaagaatggggaaagggccaggcgtggtggctcacgcctgtaatcccagtagtttgggaggctgaggtgggtggatctcttgaggttgggagtttgagaccagcctggccaacatggcggaaccccgtctctactaaaaatacaaaaagaaaaaaaattagccttggtggtgggcgcctgtaatgccagctacttgggaggctgaggcatgagaatcacttgagcctgagaggcggaggttgcagtgagccaagatcgtgccactgccccccagcctgggtgatggagtgagactctgtctaaaaaaataaataaaaataaaaataaaaggccaggcacagtggctcatgcctgtaatcccagcactttgggaggccgaggtgggtggatcacctgaagtcaggagttcaaaaccagccaggccaacatggtgaaaccctgtctctagtaaaaatacaaaattagggctgggcgtggtggctcacgcctgtaatcccagcactttgggaggctgaggcaggcggatcatgaggtcagcagtttgagaccagcctggccaacatggtgaaatcctgtctctactaaaaatacaaaaaaaaaaaaaaaaaaaaaaaaaaaagccaggcgtggtggctcatgcctgtaatcccagctactcaggaggctgaggcaggagaatcacttgaacccaggaggcagaggttgcggtgagcggagattgcgccattgtactccagcctgggtgacagagcaagactctgtctcaaaaaaaaaaaaaaagttagcctggcgtggtggtgcattcctgtaatcccagctacttgggaggctgaggcaggagaatctcttgaacccaggaggcggaagttgcagtgagccaagatcgcaccattgcactccagcctgggcaacaagagcgaaactccatctcaaaaaaaagagagaaagaatggggaaggaagccttcccttgagaactggtgtgggagaagagaggaaggaggaaaacaaccccctgctgctcctcagccccctgggggtcaagagaggccactgaggcctcctcccttccagatgctccaggttagggtcaggacaggggtcaggacaagctctgggacattttccgtgacagtgtttctaacacttcttgtgtgtctcaaagtcccaatttctaggtctttgtctgagtcttcagagctcaactgctgcatgtgtccaccccaaacccaagccacaccggccatgtccatattcacctacaagtaaggggagccaaagactaagggtctgaaagagggggctcctctgacaatgacaagaggaaacagactcccaagtggccagaccacttcaattccaaacaggaagtggttaaagtgcaggcaaggcaagaaagggtgttgttaggtgacagagcttggaggctgaagtcccagactagacgccttcattaaatccatactgtgcatcctccctctgcccagccaggaccttatcaaagcgggcaccgagcctcagcaggaacaccgaaaggatggtagagaagtcagccatgctgtgctaaggctctgggccttgtcagttttgtgtaacagagtgacccaagaagagctgtgaatgcggcagatcccgtggggactctgggcaagagcttgctgcagagggtggtggagaagcagcagggtgggtcagcgtgcatggcctggaggccaagagatgacttggagggtaagaagagtgattcccagcctgcaagagctggacctgggcccagaagggaagagcaacagtggatctgttccaccccggcctctccctacaaagccagtggatcaggggaggccccaggcagcactggcctcaacttcaaggcctgtaggagcagtaggagactcggatcagagagcagatgatcaaacagcagccttgggagctctgagcactggtcttaggagggggaggggaggaaaccggagcaaggaaaagctcaaagaaggaccctcctgcatgtcagaggcttttgggtgctctggaggtcgataatttctgccacgcaagttcctctatttgtcctccaaatctagaatcctggaatggtgtttggcatgtacgctcaggggaaatacaatatccccaaacccctggtccccgctccctgccccatcccagccccatcccatctccccacaggctcatatccaacttcttttttggtctcccagtatttgccacctagcttgccaccgccctgggcagtcggagacaggcaggaagcagccagaaggttgcgagatataacagctgggagggggcgctccctcctctcctcccactgctgctgggtctctgatctctcaccattcctcaggcaattacagagcaagcagctagggttgtcagctcagcaggccctctaccccccaccagcaccactaagggcaaaggagcggggaggggggagtgttccacagatggagccaaggccgggtctgccaagggtgacagacagagtgagaagaggcaggggggagcaggagacaaagacagacgtaggaagacagcgctaaccacgatggagatggttagggggtggggaaattccgaaacggagacccaggcagcagagaaagggagagaagaggaaaccggagcacaaagggtgagaggcagctgcagagtgcgccgctgagaaatggcagaaagagcgagaagagtgaggggtgggggtgggcgtgtgcacgtgcgcgtgcgcgcaggccgcctgcacagcgtccttgtccctgggggctgtgccaggcaaggggcggggaggagggaagatgggcctgggtcagtggaggggcttcccggcgtggacgtcacgctggcctgggagcagggtagagagacagacagagggtggagcagctgtgagctggggccggaggggcctacaaagccccacgcaacagagcatcaaggccctgcccacttgtggcactgggcaagggacggccgtgagacaggatgaatggcacactgctggctgacccatgccatgccagggaacaggtgggggtcgggggattcctgctgcgggtaggaacggggggagggggaagcacccagaaaatcccagggaagccttccaatattgctgctggctgggagtaagtggtcacctggctggaggagacgcacatgtgttaggccaagagtgagcctgcgtgaccatgcactgagtggacagtggccgctgtgctggggcagttgaagatggggccattcctgagtaagtccggtcccaaacccatcctccccggtgggaaagggccagggaggcaagggtcacgcccagcagcctacagggaggggttcagccccagaagagccttgccccatcccaccccacctggcctcccactacacccgcaggtccctcagggagtcctctgtcctctgctccaaagtgcctgctttggtctgatgggaagcagcttgccagggagggacctgggaggttgtggagcctggctagacctggagtgactgcctcctccctgaaaacacacacacacaccccatcaccaccaccaccacacaccttgagaagggaacctccagcggtgccctgcacatgtgccctgcacacctgcctgtcagttctcaggttctgcctggagttcctctcaaaggagaagcaacaagagagcccttcaacagcacagcagagactatccggcttctcctgcccttgtctcctggggacatggtgcctggtgactcagtgggccagagtgggggtggggctgggggctcagcacagggcacatgaaagggtcagagtgtggtgctgggcccatgtgcttgcaggcctgggagcctggggggcttctgtgcctgttggtgtgtatacgatggtgtgggtgtcacctacaccctgtgcactgtgtccctttaaggctcccgctggccctccccgccccgctccccaggccgtggctggcgggtttctatggtgatgcagcccaagtcccagaggtgggggaagccagaggaaagccttgttatgtgttatgtagacagcacataaagggggctgctccagggagcccccacaggtacctgggggcccagaagtcctttatgactgctgcttagtccctgcactcccaacctcacccctccctaagagggtacccttaggagagagtgagccctcagccccctcatctcgcctgaggcttcagtctccaaggcaactacaactcacctgtaatggaccattctccttaaaagatggggaaaagagacggaggttaaccctttgtggggttcagggaggacggtcttgactactggggaagggagggaggagccccactccatccccacaatcacatgcctctgtggtctgttctattaaatcaacttacagcgtggacttaccacgtaccagaaagcctcatgagcacttccactcacatccactcatctcctccccagatttgcctcagggagggaggtgctatcatcatccccattttacagatgaggacacggaggctcagaaaactggaaactgtgtccaagatcacagagctggcactgggtctcagcaggggtggggttttagagggcgtggtggctccctaagctgcctctcagaggctctggcatcccaacatgtgtgcctgctgggcttcccagggaaccaggggcctgggcgaggatggcctccaagccatcctgccccgtggggagggcttacttgccaggcagatggcaggcaaatgtcgggggcagggagtgacatcttgggatggaggccatgcggaagtaggatgtgatcaacatcacgtctcagcacagagctgaagcccgacaccaaacaaacccccaagtcccccatccaggtactcagtccaagagaaggccaactcctttcccttttgggcttggggacaggctggtttcttggtcccctcttctgctctctggaatctggacttgttctgatacctttcttgcaaccagaggctccagaacccctcccaaagaggcccctctccaatcagcatttagggacagcagtggccccattcttgtgtcgaaggagatactgatgcccagcaggcggcaaggcttcagcctccgagacccctagaaggcgagagaaatgaggtggcagcaaaactagggctcctctcaggccccaggcctcctcagggagctaggatgaccctagcactagagggggcttcagcggccaggccagaaggaacagactgcatccagttcctggggctgtggcctgaaaaggagagcagggaaggagcccagcctggggcagggagaggccctggcccacagcagtcctgggatacctagcctgtgttggtttgcggggggcggggtgggggtgcctggaaacagctcagacactgccaggccccacgggccccctccaggggccccactcccgaggggttaaagggcagagggggacacaggaagcccgggggcggacaatggggcctctgtgatccccagggcttgggcattcctaagtcatgaacacagacgcagatggctgggagacagggccacagggaacccccctccactgaagcacagcctgggttggccagaggctctgtccccatccagccactgcagcagccaccctcagccccaccccttcccagcacaggccctgttggggcatctgaggagacccacgtggcctcatgacaatatgtgtgtgcatgctggttcacgaacacacacacacatgcaaccaaatatatgaccccacccagacaaacaggaatactggaggttacacacacacaaatacacacacacaagcagagacacaaaccccatacatgcagataggaagtctgcctggctggagggcagggggcagaggggctcccgggactcagtccctttccctcaagttccactctcagacccgcactgggatggacgggttcagaagtcctctttggccaagtgcatggagcccaggacgctgccaccctcctgccccacccaacccctggccctcgcagctgcccctgctgggtgtaagggccagagatgagcaggagctgctgactgacagtggctgggcactccctctgcagctttccaacctgggaagaacacggggacctgggctgggggccactggacaaagaaaagcttctagaaagaacagcggccagaccctccccagctcctccctctttttccagccacagccttcaggaagccacaaagaccctgttgatatctggggaagaggcaagctgggcgggctacctcccccagtgctcgtctggctgctgctcaccaggcaccccccatacagccttccactcagacaaggcccccatggggggtctgggcccaaccccaaggcgtagagtccagcagaagggtgctgagtggctgctggacagggcacaacctcagggccctcaagggtgaggcaggggcagctgggggggacaaggagaggagcagagcggtggaagacagacaaaagggtaagcagagagatggagcagagccctgacgggaagggggaagagggaagggagggccaggcaggcagaggcagagggaggagacggggagtggtgcaccccatccccggcagcagcaggcttctgcctagaaggaggaggaaggtgatggccctgggggtggggcacagggagacgtgggaggctgcagaggagagagcaggggggcgggggaagcaggagaaggaggtgtccgagatgggccagatcagagcaagtaagacagcgactgcaggggcagggatgctgcaggcccattccagatggccccacccagggacccagccccagcccattgcaggggcagaggacagggcaatgagcaccctgctggggaccctagaagggcatccagaccccccgcctcccccactgtctgaaccacgagggagggaggcagggcccccactcatgcccccactcatgcctggcagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtagggcacacaggcctgtctcctcgaccctcacctgccagtcctggccaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctgggtagggaagctcttcactggctgcagggcaggggaccccgccaccttgaagcgctgattgtcctcctgatgctcagcagggagctggcagctgggaacttggggaggagccttttaggagcgcggtgtagcaaaccagggaggctggggcgtgctgaacgtgtttccctcttggtgatcagatcactagcgattcttaatttcttttgttcttttctgtatatttcaagtgtcctacaataagatgtattactttcgggatcatacacacacaaacatcaataaatatggagagagactcagatgcagcagagagaaatgaccaggagccaaggaggtgggaaggtcccaggcccaaccctgccccaaacttcccatgtggccaagacagccgagtcctcaaaggctctggagccctcaggtgtgcacatgtgggcactgcatgggagctgtgccaggggagaggccaggctgggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcccagcctccgcgcacgccggcctcggacccgccgcccgagcgcgtctgcgatgccgatgctgcggcagcagcggctgtggcggggcggggcgggcgtgcgcgcaggggcgggggaggggagcgccggggaggagagggagggaggagtgagatcacctccccggccgcccgccccgccccgccccgccccgccgcaccctagcccctggtgccagccgagcgcggcttgggctgggggcccccgggcagcccactccgggagctcagcgggaccccagccgacgggtcccgccagacccccttccccgcagaccgggagtctccggccggagagtgtcctcagccccagcgcaagggagcccgctgtgaaagctcggagcgggaatcgcggggcgagagtgctcccagaggcctggggccgggcggtggagagaggagtccggcaaggaaggggatgctcccttagcctcggcctggccctcgacggcgccggccagcgatgggcacctgcacgcaacgcccccccaacacacacacacagggcaggactcccgggacctctcccgaatgccccccgatcctgagggcccagtcagggtcctgttgggaggggtgcgggggcttcgtcctcagcgtgttggggaggcgccgcggagcaccggctcctgcgcaccccagagcccaggtgggcggcagggtaggaggcgagcccaggggagacagggtctgggagagggtatccctcgaactgccacccccaactcccagattttcctccagctctctggtgtcttatttctttgtcctcgggattggccccattcgacctttcccgccgactccactctctcccactctcccccgcagccctgcacaggatcgagaaggaaggagctcctccccagtgccccctcctaggctcaaggccatgacctcacaggcgaggaagcaaaatggagggggtaagaattccggagccggcgagctggctgcagcctcagggctaggaaggcctagggccccgatggcagattgcagatctggcggccacggtatttttatgggcatgcctgttgcccagtgaagcattccaggggccctcgactcagtctcacaagactccccaagtggtgtggggccctggagggcccacatgggagcagccctggcatcctggcttggatgccccacccccatagtgccagcttcagttcccctggaatgggaagcttggggtggacccatctgtgctcagagagggtctggatgccatgtttgcccagcctttaggaggagaatggacaagactaggcacctgagtgaagacggacggctagggagactgcttccagagtgggggcacttgcagggcatcttcaggtgacagcagaggaaactgagcccgcctgggtcacgaggccagcaggctcatgagctgggccaagagggcgtactttccatgaggcactgagctgtggtcagcttcctgcctttgctgatctgaactctgataggcctctctcctttccagttgctgcctccactcactccctacgttcccagcctttcctccaagccccaacttctgcaaatcctttacctaatctagggtttgatgcccatcaggatggtgaagtaagcagggaatagagcccgtttatacgcacctgctaatgtgtagtgatgggtccatttatggtaacaaaaaattcattactaggattacacgacatcacatttcctgagcacagccatggacctgccatcgttacatttcctgcacatttaaattgcacaccaacctggggaggtctgttgaagcattcgccccacgttacagatgagaaaaccaaagcccacagagctcaaggctgggtccagcaagcacagttaggaaggtctctttctctccactggctcattgcatccacacacacaccccagatgatggtgctgttattatcctcactctcccagtgaggtacccaaggtccagagaggggcagtcatgcaaccaggaagaaattggcactatcagtgcccccatttcacagatgaggaaaccaaggttcagaggggtcaaatgacccacccaagatagcccagaaggtaaatggcagaactcggacttgaattcccttctgcttgaccacgatgcccattctcacttccatgtaatgaagtggaggagccaatgggagcaagagcaagagtgacagaagaccaagggcagagcaagtcccaggagaagcaggagggactggccctgaacaagaggcaagccacccccccactgccatgtgcttgctgttggaggttagggggacaccaagtagacagatgactgtctctttcccttcaacgtcaagtgcttctcacagccctgctccctgtgacccagccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctcaaaaaaaaaaaaaaaaaaatcaactttattggagtataatttacatacagtaaaattcatccttttgaggtttacagttcaaggagttttggtgaatgttgtgtgcagccaaccactcccaccaccccctgcccttggccaccactgatctgatttctgtcttttctaaattttattataaatggaatcataccgtatatattcttttgtctggcttctttcacactcacgcagcatactttttgagcttcatccatgttggtgtgtgtgtttgtgtgtgtgtgtgagagagagagagagagagcatgcgggcgagagagagcagtatatttccttttgattgccgagtagtattccattgtttggttggatcagggtttgttcagccattcactcactgaaggacacttgggtagtttccagctttgtgtgattatgatggagcagctctaaacatttatatgcaagcttgtgtaaatgtgtgtcttcatttctctaaggtaaccgcttaggagtggattgttcagtcaagtggtagattgatgttgaacctgcctttgtctttgaactgtgcaggtcagctggtcacacggtgatgactgctgctatctctggatgtagtcacgccaggtgagtatttgctttctatttgtcctgctttccccatctctctcccccacctccactttattattttttattagtgttgttattactttgagacagggtctcactctgttccctaggctggagtgcagtggtgtgatcatggctcactgcaacctcgacctcctgggctcaagtgatcctcccaccacagcctcccaagtactgggacaacagatgtgccaccaccacacttgattaatttttttttcttttttggtagaggtgaggtctcactatgttgtccagactggtcttgaactcctgggctcaagtggtgatccactgccttggcctcacaaagtgctaggattacaggagtgagtcactgcacctggcctcacccccacattgtatcagtgaaggtgtgtctggagttggttccttccagtgggttcttggtctcgctgacttcaagaatgaagccgcggaccttcgcggtgagtgttacagctcttaaaggtggcacagacccaaagtgtgagcagcagcaagatgtattgtgaagagtgaaagaacaaagcttccacagcatggaagaggacccaagcaggttgccgttgcttgtggggggcgggggggggccagcttttattcccttatttgtcccctcccatgtcctgctgattagtccattttacagagtgctgattggtccattttacagagtgctgattggtccatttacaatcctctagctagacacagaaaactggtgcgtttttacagactgctgattggtgcatttacaatcctttagctagacacagagcgctgattggtgtgtttacaatcctctagctagacagaaaagttctccaagtccccacatcacccaggaagtctagctggcttcacctctcaaaggttcagggtaggaagcagaaattcctcccgtgatcatgaacagaaagggattctgtagaagggattagatgcttacctgaccattggatgggccaaaggagtggactctgggctaggtgttgataacaccagtgcagacctggctcctcaagggagctgctacctctgccaccatccacaagatgggggattgggaggcggccagtgtaacctttgagttcaaaaagacaccaccaaagtcatgacctgaggatcagcaagctgggaccaggaagccattgctgccacaagtgcccctcaacaaccaagaagtgaaggttagaccccagaaattctttgatgtccagcagaaacgcagccccacacagcagaagtgtggcttcccttccttcagtcatccaaacttcatgtgagcacacccaatttggcaattggcaaatttgccaatttgccaattggcaaaactaaatttgcttcccaaagtccagctgctctggagtctggaacatttccagcctctgccatgcagagcccacaaggtgggagtgagtgccgagagctgtcaatatgcccaggcagatgctctgctcttggtcatcttttagatggactggatttgttctctcattctattttctcctctgtttgtttagaagtgctctatgaattttttagtagttcctctacctattttaacatgcattcttaataaagtctaaagttaactaatacctctgctctggtggttttaatgtaggtccataaattatttgatactcctgccttcaaaaggtagtgcttaattctcctcctcttgagtataggctggacttggtggctcacttttttttttttttttttgagatggagtttcgctcctgttgcccaggctggagtgcaatggtgtgatcccagcttgctgcaacctccacctcctgggttcaagcaattctcctgcctcagcctcccaagtagctgggattgcaggcgtgggccaccacgcccaactaatttttgtatttttagtagagatggggtttcaccatgttggtcagtctggtctcgaactcctgacctcaagtgatccacctacctcggcctcccaaagtgctgggattacaggtgtgtgagccaccacttttttttttttttttttgagatggagtttcactctgttgcccaggctggcatgcagtggcgtgatctcggctcactgcaacctccacctcctgggttcaagcgattctcctgcctcagccccccaagtagctgagattacaagcccccaccagcacgcccagctaatttttgtatttttagtagatacgaggtttcatcacgttggccaggctggtctcgaactcctgacctcaggtgatccgcccgcctcagcctcacaaagtgctggaatttcaggcttgagccactgtgcccggcctcatttcttttttaaattttattttagaagttgaggtcctgctctgtcactcaggctggagtgctgtggcatgttcatagctcattgcggcctcgaacttctgggctcaagtgatcctcccgcctcagcctcctcaggagctgggaccacaggcacacaccaccacacctggctcacttctgatgaaaagaataaagcggaagcaatggctgcagctgtggggactaggtcacacaggcactgctgcttcctccttgttttctctctctctctctctctctctctctctcggattgctctgttgggtgaagccaggtgccacatcgtgaggacactcaacagccctatggaggagctcacatggagagaaacaaaggtcttccgccaacaaccatgagtgtgccattttgaaaaggatcctccagccccagccaagcctttgcatgactgcagtcatggccagaatcccactgcagcctcacaagagcctttgagctagaacaatccagctaagccactcctgaatcctgacccacagagattatgagataataaatggttactgtcattttgaactactgcatttgggggtgatttggtttgcagccacagatcactaatacatcttccctcctcctacacaatgcacggcctgggataacatactagccacatgaggtgggccctattatcatgtaggaatgaggaaggcagtgagctcagatatgtggacaggaacccaggcagagtcagccgtctgagctttgggaagcctggttttcagtagctctagggacttacccacacccccacactcccacccctgaactgctattatggtgctgtagcccccacggtgcctgtcactacccaccagctgctgtcccctctcctctgtgtccatcttttcttcatgtctttgcttctcctggcattctcctgctttgtgacaaatacccgtggctttttctgcacatgtcttttggcttctaatctcactgcagtttcaattccaagagagagaaacttatgggcccaaatactcattatcctcattttggtggagccttcatgccaggtaacttcgtaggcaactaaccagcctatggactagctagtcttggccaggtgcgggctcctggtccaggcagctgaggccaaggttggttcaagctgtgtgataggcagtatggccatctgttatggacttaatgtgtgtgtacccccaaaattcgcacgttgaagtcctaacccccagatggagcagataaagaagaacagagaggctggacatgatggctcatgcctataatcccagcactttgggagaccaaggtgggcagatcacctgagtccaggagtttgagactagcctgggccacatggtgaaaccccatctctacaaaaaatacaaaaaattagccaggcatagtgacacacgcctgtagtccgttactcgggaggctgaggtgggagaatcacttgagccttggtggggaggctgtagtgagccgagattgcaccactgcactccaacctgggtgacagagtaagaccctgcctcaaaagaaaagaaagaaagagagagaaggaaagaagaaagaaagaaagaaagaaagaaagaaagaaagaaagaaagagaaagaaggaaagaaagaaagagaaagaaagaaagaaagaaagagaaagaaaagaaagagagaaagaaaaagaacacaagaaaagcactgttccctcccctccaccactgcccctaccatgtgaggacacagtgagaaggtggctgtctctaaaccaggaagacagccctcaccagaagtggaccctgccagaccttgatctgggacttccaacctccagaattgtgagaagataaatttccattgtttaagccacccagtctgtggtattttgtgatggcagctggagctgactaagacaccaccaatgggtaagtcactggctagtggtgctgctgcagcagggagtatgtcttggtgggcatcttgctcgacctctcctatctaaccacactgaagtcatgcattcccttgtttttctttatactaggcccacgaaaccccatgctttgaaaagaattgcttgtttgccttcaccactcctcctcacagcctggaggtgatcatgttactgtgtagactggtatccctagggacttatgggctccaaacaagctgcccatgaatatcacaatcctgtcacatgcccttagccagccctgcttcccttccacgcagtgcaccggctgggtgcagtggctgatgcctgtaatcccagcaccttgggagaccaaggcgggcgggtcacttgaggtcaggagttcgagaccagcctgtccaacaaggtgaaaccctgtctctactaaaagtttaaaaaaaaaaaaattagccgggcatgatggggcacctgtaatcccagctactcgggagactgaggcaggaaaaccagttgaacccaggaggcggaggttgcagtgagccgagatcatgccactacactgcatcctgggcaacagagcaagactccatcagaaagaaagaaagaaaagaaagaaaaggaaggaaggaagaaaggagaaagtgacagattaagcacatacattcactttctcttcctcatgaaatcccaccaaaatgacagtaaatgactttttaaaaagaaaaactcccaaggacagaaataatgggaaaatagaaaacagcagcaaaatcatgggagctgaatttcactgcggaacccacacgcatccagaaaatgggggtgagtatggaagtgccattaaaagtctgttgaagaggcagtcagatctccacatgcttttccccatcccaacggaacagaatgtttattctttggagatgatgaaacaaagagtgtttcaagtggggagtaccaggaacagcttagatggcaccatactaaaaatgagggggttaaataaatatttacctactgaatttggaccactttggaccctcctggcccactctgtttctcaagtgctgacaaccagcctcaggcagcaggctaaagatctatctctgggtatttggccatcccaaggtgaacgaaaaggtagtaaaattggggttctccaataaaaccagccccgctacatcatcctatgatgaagctcatagttgacatgtccttccttttcaatcagctcattagtgccccattctttttttttttttttttttgagacagagtttcgctcttgttgcccaggctggagtgcagtggcacaatctcggctcactgcaatctccacctcccggattcaagcgattctcctgcctcaggctcccaagtagctgggactacaggtgcgtaccaccatgcccagctaatttttgtatttttagtacaaacagggtttcaccatgttggccaggatggacttgatctcttgacctcaggtgatccgcccacttcggcctcccaaagtgttgggattacaggcatgagctgccatgcccagcctgccccattcttaaatatgagaagacaaccaaggatcaccagacacctgaggaaaacctttagcatgaaagcaggaaagatcaaaatcaaaacaaacaggaaaacaattgttgggaaacacgactatgagaggtaataatttttaaaactaggctgggcacggtggctcacgcctgtaatcccagcattttgggaggccgaggggggcagatcacaaggccaggagtttgagaccagcctgaccaacatggtgaaaccccgtctctaccaaaaaatacaaaaattagctgggcgtggtggcgcatgcctgtaatccaagctactcagaaagccgaggcaggagaattgcttgaacccaggaggcggggcttgcggtgagctgagattgtgccatggcactccagcctgggcgacagagcgagaatctgtctcataaaaaaatttttttaaaaagaatttttaaagctattaactcactcagggagataatagaatgtaaaaatatccatgaatcaagaataggatgctataaaaaaggaacattcagcgaacaaacaagagttttttgtggaagcatacatgaaaaattcaatagatggatatttttcttctaacaaaatacagaaagttgcaagacaacatcactcccatcctagctacaagaagctggataacctacaaatcataggattttttttcttttaaggctatcgggaagctgaggttggggggaaaaaaaatcaaaatcttgaaaagccctttctaggagaaaagagccccatagctgctttgatttttggcacagcagcagcaggaagaggaggctgccacagacttgtgtacaaaagaaacagagaaactctgaacacattttaaaaggctgagtgtgcgacggcatgaggctatagactctctaatgcctcccattcaagagagcttacattcacccactaactcttttgcatgggccttcaccaagaaagtttgaaggcaaagcaggtgggccgaaagatactctccgaggtagacatgtgctcaggctgctgaagtctggatgcaggacaagggaaccgacaggaacccccctggggctcctgaccttccactgagtacagagcagctgtaactggtgaatgaagcagggcaggaggactgaagagttcatccccaggctctaggaagtcttaaggcaggacagaagaactgaaacaaaccttccggttgattctaatccttacactgagtacaaaccagaagcgaactgtggttggagtggaggcaaaagacctacaataggcacccgggaatgtgcgctcagggatctgctgaagtctacgggtgaggcaggagaatcaaagaaactcccagccactcagatcacaagtcccaccaaagagaatgttctgatcctgctctgaaatcattcgaagtatacagaaaactgagtctacgcaaagcaacaagaaaccccagactccacttaactacacaccagcctctaatacacacacacgcatgcacacactaatggcctgacaagaagggtcatgccctttttggggcataattttatgtgtatcttccccactgttctattacatatatttaccccaggagggataaatatatatgattatttacttcttaaaatagaaataggccaggtgtggtggctcacacctgtaatcccagtactttgggaggctgaagtgggaggattgcttgagcccaggagtttgagaacagcctgggcaacatggaaagaccctgtctctataaaaatacaacaattagctgggtatggtggtacatgtctatagtcccagctactcaggaggctgagatgggaggatcccttgagcccgggaggtcgaggctgcagtgagccgtgatcatgccactgcactccagcctggctgacagagtgagaccctgccttaaaaaaaaaaaaaaaaaggaatttgggaagggctcacctgggcagtcctggcccaggtctttcatgtggtggctgtcagatggtggccctcttcatattgcctcagagccttttttttttttttttttttgagaaggtgtctcactttgttgcccaggctggagtgcagtggcggggtctcagctcactgcaacctccgcctcccgggttcaagccattctcctgcctcagcctcccgagtagctgggattacaggcgcacgccagcacacccagctaatttttgtgtttttcagtagagacagggtttcaccatgttggtcaggctggtctctatctcctgacctcttgatccacccacctcagcctcccaaagtgttgggattacacgtgtgagttactgtgcctggcctcagagccattttctgtggtccttccatgatggctgaattgggcttccttatagcatcagggaagttggaatgcttacatggtggctaaaggcttgaagagtgagtgtccctgttaacaaggcagaagctgcattaccttttctgcactagcctcagaaatcaatcagcaccacttttaccatattatcttgagtacaagaaagtcacaagcctgcccagattataggggggagggttaaattccacctcttgatggggaagtggcaaggttccaggagagcatgtgggatgggagatattgttggggctacctttgaaaaacacaatctgccacacacaccagttaaaaggcagagactgttgggctagataaaatagctatatgttatttacaagaagcacatttgaagcataaagacacagacatgttgagagtagaagtatggaaaaagatataccaagcaaccactgagcataagaaagctgccatggcatcatactaatatcaggtagagcagaattcaagacaaagagtttactagagatcaagagagacatgtcataatgaaaaaagaacacataatcaagaaaacacaaccatttcaaatatataagcacctaatctaccaaatatatgaaacaaaatttataggactaaagggttctagatacagataaatctccaaacatactggccaactttaacattcctttctcagtaaatgataaaacaaataggaaaaaaatcagaagaatatagatttgaacaacactatcaacctaattgactcaattgatatgtacggaacactacatccaacaacagcagaacacatattcttctcaagtgcagatggaaccccaaccaacacagacaacttctgggcaatcgagcaagcctcaataaattacaaagggtcaaaatcatacaaagtacgatttctgaccaaaatgatgttgaattagaaatcaacaacaaaaagacatctaggaattttctaaatattttgaaatgaaaaaatatctacttccaaataacccaagaaccaaagaagaaaccacaagtaaaattattggtagaacatatctttcactgaatagaaatgcaaataaaatatgaaaatttgggaattcaacaaaacaactgattagaggaaaaggaactacttatattagaaaagcagaaaggtcccaaaataattatttaaatttctactttaagaaactagagccggtcacggtggctcacacctgtaatcccagcactttgggaggccgaggcaggcagatcatgaggtcaagagatcgagatgatcctgaccaacatggtgaaaccccatctctactaaaaaatacaaaaattagctgggcgtggtggtgtgcacctgtaatcccagctactcaggaggctgaggcagaagaattgcttgaatctgggaggcagaagttgcagtgagccaagatcacaccactgcactccagcctgggcaacaagagcaaaacttcgtttcaaaacaaaacaaaacaaaaagatcaatgaaattgataagcctctagccagactgatcagaaaaaaaaaatggagagaagatacaaattaccaatatggagaataagagagagggggcattattacagatcctacaaacataaaaaagtgataagaggatgttgtgaaaaacttattccaatacatccaacaacttagatgaaatggacaaattccttgaaagatacaaatggtcaacgctcatttaggaaaaaatagataacctgattagccctgtatctgtcagaagagttgaatttataactgaaaaaattctcacaaagaaaactccaggtttgtgtaaataataccaattctatactaactcttccagaaaacagaaaaagagagaacacttcccaactcgttttataaagtcagcattatactcatccccaaaccaaagatattacagaaagggaaaacgtagaccagcatctctcattaatacagatgtaaaaatggtaaacaacagccaggcacagtggctcacacctgtcatcccagcactttgggaggccaaggtgggtggatcagaggtcaagagatcgagaccatcctggttaacatgatgaaaccctgtctctactaaaaacacaaaaattggccgggtgtggtggctcatgcctgtaatcccagcactttgggaggccgaggcaggtggatcacctgaggtcgggaattcgagaccagcctgaccaacatgaagaaaccccgtctctactaaaagtacaaaattagctgggcatggtggcgcttgcctgtaatcccagctacttgggaggctgaggcaagagaatctcttgaacctgggaggcgaaggttgcagtgagccaagatctcgccattgcactgcagcctgggcaacaagagtgaaactccgactcaaaaaaaaaaagaaaaaaaagaaaaaaattcaatactcacttgtgataaaagctttcagtataccgggtgacagagtgagagactatgcctcctccccaccaaaaaaaatataaaaaaaaaaaagaagttacacaaaatactatgtactcttttatttatttatttatttttattattatttttttttgagacggagtcttgctgtgtcacccaggctggagtgcaatggcaagatctcggctcactgaaacctccgcctcccgggttcaagcgattctccagcctcagcctctgagtagctgggattacaggcttgcgccaccacgcccggctaatttttgaaaatactacatactctatgattctatttatataaaattctagaaaaggaaaatctatagtgatagatcagtggttgctaggctttcaggtaggggaagaagcttgactgcaaaaggccacgagggaactttctggaatgtcgaaaatatttattctatgtcatgattgtggttgtggttacacgactgtatacatttgtcaaatcttactgaacagtacaattacaattaatgaattttactgtatgctaatcatacctcaataaagccgaaaaaaaaaaaagtcattctggaggagagaaatcattgcctgcggagggccattccagggtggtgagtgcatgagcactgaagacacccggagcagctgctgcaataatctgggggaggaacgtgcaggcagagagagcaagaggaagtcagactgggaaaccccgaggcagttacccaaacagcccactaacagcaactgcagtcggccgcctctggggaggaaagcgggaggggccactgcctttaaaaaagaaaaaaaaaaaaaatctctgcagttttgccagggagccgcctcctgcctgactctcacatgatgacctggaggccatctatgggtacggccctcaagccctcaacgctcaccctccttctaccccccgcccctcaccccagcacctgctggagaccctggccctcccttccactccgcgaggctcttaatctatccagttccatgggctgcctttccgcagctataaacaggctctgtccagctttcccagttattattcacttaggtgaatggacacaattagatgatcatccgcaggctgtcttcctgtcatcattggcacacgcacacaccctcacacacgcacacaccctcacacacgcacacaccctcacacacgcgcacaccctcacacacaacccccccaacgccacacacacacacaccacacaccctcacacacaaccacccacgccacacacacaccacacaccctcacatgcacaccctcacacaccacacaccacacacaccccacacacacgcccaccctcacatacgcacactctcacacacaccctcacacactctcacaccctcacacacgcacaccctcacacacaccctcacattcacacaagtacacttgagtttttattaaatttgtttttgtccccttcaatcccatcctccaacccgttgttcctccctatctcctgggctctaggtattctccttcgggtcacagtccctgtgagggccgttcctgttgacaggcacttggctccgtccttcccactgcccacaggctccaccatctgcacatgcacccctcccacacaatcgggggcctctttctcctcgtccttggctgcctcctctttgtcttccaccccttacaaatccttcagggccctttaaatgccttttccacctgcctgctccctctagccccgctgcccagtgttaagtgggtcgcaccatttctctcctgggtgacaggcacagcttccaccagcctccctgcctccactcttctctgcagaagcccatgtgctcctggggcagagcccaggtccttccatctctgcagccacagtgctaggccagcggcacttgcagtttggtgaatggaaggttctgatcatggggaaccggtagatagagagggacaaacagtgtccccccaatctgcctcctgtcctcttctgcccagacactaggctggaagatcaggagccacaccttggcactcacagagccctttctgcaagtcttagagggaccagtgggaggtgtgcacacaggggctgcgctggcaggagtgggggcctggcacacccccaggtagatgccctgcccgttaacgcccaagggcaggggcttgagtgactcatgtgggcctagcgtgaatcagcacagtctgcccttcttcccatgggagctgctgcccagccccatctttcttggcccccgaggggtggctgcccagggcctctctcctggcacagttccatgtagtgcctgcccatgtggctcccagttcctccccggggtcctggctgagcagaatggcactggatcctgatctggcttcttgcatcccagaggagaccgccatgcgggcccttcctccagattcttccctagtttaacaacaggaagcgaggagtccaggggggcagagattgccacgggcctggccacattgctaggggaggtcccaacctgctgctgagatccggcactgcacagcctcgttcaggcagagaaactgataaggagatggttgtctgctcaccccaaaaggttagcatggattcctcgccctagccggctttagacggagggaacaaaggctttcccaaggccctgccagtccccacccctgcccatcttaccaccgtagtctccctcaatcatcaagtcccattgcacagaaggggaagctgaggtgccaagagctggcgtggcctgttcaaggtcacactactgggcaggggccaagcaggggctggagccttgctttcctattccccagccagggtccccaaattctctgccagttgagggaagccatctcctattccactgatctgggtggcattaggaaggccttttctatgctcctagattagtgacagcatgcggttattggggacagcatgaggatgtgcatgcgctgaggagatgcagctgaagcgtcaggcctggggtgccagcactctgcagcctgcccccaaggggctctgcaaaaacatggcaaagatgcggggtgtgatgtgcacctgtgtgtgctgcgggtgtgtgcgtgtgtggtgttggctgtgcgtatgtggtgtgtatggctgtgtggtgggtacatgtgtgggtgtgtggcgtatgggagtgtgtgatgtgtgcatgtgtgtggtgtgtaatatatgtgtgcatggtgtggtgtgtgtgtggtgtggcgtatgggtgtgtggtgggtgcatgtgtgtgtggcgtgtggctgtgtgcatgtatgtatgtggtgtggtgtgtgcgctgtctctggaaaatgcccaccctgtgttcccaccaccctaacagggccgggaggggccagggtgctgccaggctctctgggcaggaagaggaggccttggccgcgggccggacttgggcctggtccgtgaggctgttttggtctctggcttcacaggcaacagagaagacagacaaacaggaagaaagcagctgccttgggctgggctgggctgggctggcctcggctgagccaagccaggcctgggtgcggggggagtggaaagagaactactgggatgggggctggagggggtgtggggacaggggaaggagagaggtgttgggggagggaggaggagggctcaggtacagggaaggtgcgtccatactcatggtatgttcaagaacatgagcgagcgtctctgtgttgtgtgtttgtggctgtgtggctgtatcatgtgaggttgtgtgtggtgggagggagcccgtgagcacacggaggtccccagcccctcttcctaggacaggtagttgcaggtggggcaggaggaagagggtgggggtgtccctggatctcacaggggttcgtgaagcctggcttggcccctgccccactcctccctttcctgtccctcgtctccggccaactgggccctaactggggaggaggaggggcctgcgtgggcctgggaggggcccagcgaaagtgttttcaccccttccttgcctgggcccagcgaggagcaggaggaccccaacttgggaagggggcgtgaagctcccatgaaaaagcagcgcagtcctgggccagacccaccgctctctggcctcagtttccccacttataaaatgggaatgctgaactaagtgacctcccagagcactgccaacccagacaatccaaccaggggggcgtggtagggtgagggtgggcgtggaggctatggcagtgggaggagggagtcctgggccgggaccagggaggccctggggaaaggaagggaaacaggaggccaggggaggcctgggggaaagggggagggggaggaagtcccctcctggccaggtcactcccagaggctgggctgggccagggcagggcagccgatggagagcagatctgagcacccagccaccttcacgccaccgcccagctgcccaggagcccagccaggtaaggggctgcgcctgcctgcccccctgcccagtccccagccctcggatggtggcctctctcggcctcggttggggcaggggagttctgcgtgtctgtctggggtgcccactcccaaacccgggactcatgggctgcctgggggatcctgggttctgtgcatccgtctgtctgaccatccctctcaatcttccctgcccaggactggccatactgccaccgacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccggtaaggcttgcccctccatgagtccggtgggcagagtgggtttgacgattcagggaagcccctctttctaaagacctccttcaccctcacctctgggtgtgtctctccaggctgccaatgagtggggaggggagcacagccccacttccccgccagggctggggctggggctggggctggggctgcccttccttctggactgcatgagcctggggtgtgtatccctcataacatggctttcctggagtcccctctgctaggagccaggaagtgggtgtccggatgggggcacgggaggcaggcctgagtccccctgcacagcaccctctctaaccaggccctcttcccgactccttcccagctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggatccgggtaacggtgggtgtggaggcagcacagagacatacacagactccccacacacacccacagtcacgtgcacagctctggaatccatggcgcaggcagccaagtcttcaaagctgcaggacccctggggaagctgttctcacctccagcacccacctgcccacccgagacagagagctggctcccatcggggaatcaacacgaggtctttatgaatcgccacccagccctgccaggcatctgagcaagggtacccgccacccagcagccactgatcagccttccacaaagctgcagaagagggctttccccagcatccttcctcagctgcctccaaaaggggcctgggccagggctgaggggcaggcaggatgtggagcgggcatccctgtgtgcacggccccatcccacctctctgcacagggtgaagtgcaggcaccctgcacttgctggacagggctggagagaagcaagggggctggggagagtggccggtccagcgggtagccgccgggggcacgcatctccagcagcggcacctcagtgtggcttgggggtcgtgtctaggccctgggggtgggaagctgagggtgaggctggggccccagggccccgggagaagcctttgttcctgcccaggcggctgctgggcggggcctttgggcttcggggcccaggactgggagaggtggtagatgctggcccaaggccctggcggacagaggtctttcccaagagctccttaaacacagagtccatgttctgtgccacagcctagcggaggggaaagaaagggagagtgaccagtgagttcccccgactgaccctgcccaagacccacctgagttcctcccactcccaaagcaagccctcagccaacatccccagtccctcagcctccaggtcactctcccccactttgcacctggcatccctcctgtccctgttggtgtctctgtcacagtctcctctgaggacagcaattccttggtttagcccggaagtggggacccccctcttctcgcccccactctttccctggcagagatcacagccccctgcccatggcctcagggaccgccagcgtgcggggactccccagtcaatgtcctcccatggcgtctcctggctgccctgtccctggctcccgctcctgctcctccgtgtctaccggaccctccctgggctccctgggcctgggggcttggccacacctgggacacccgcatgttcttgggctctctcctccttgggcttagcaactgtcccgcgggcttccacgttcagcccgacagtgttcacagggcccatggtacagagcacggagcagggtcccccaggttgtgcgcttgccagggccacatcttgagccttcgctctgctccttcgagagccgctgctgccccaccccaatccccaaccagccaccccctcctgcctccctgccatctgtccctttcatcctccctggcgtgccaagcgcctgccatggcaccgcctgttacctagcccagctacaaatgccagccttgaatctgccctggagtcccttgcctctaccaggtaaacagccttaactcagccctgccactccctgctctgaagctgaacatgaatcccaacgtgcaagccaggtgtcttctgtccctctcatccctgcctccgtagccgtccctctccatccccacccgccctcacatctttgccttcctgccctccacaggctctgccttgggcctgtgtgtctggcggcaggttcccttgagctaaggccagggagggcaacgactggaacctcgaggagggaggagtttggcttccaaggggaggcagagatcccccaggacagatgtccctcacctgccacacacccactctcaccttatccacctccacgtgttgctctggggaggctgggaccaagcagcgtcgtctgtgtccagagggtcccatggcctcaggtgaggtgcatggctctggcctgcaggacagacagggagcctggtgggggccctgggaagtccctgagctagctgggcagtggctcctcccatcctggggtgtggccaaggaaaggaggctggcccagtggtccccaagctcctctagagcctctccctgtcacaagctgggtcattctgtcacgtcctcatctgccaactcctcccactcccactggccaaagcctgaccccagtcccctctggcctagaacagcacacgtgtggccccctgagccccgtcttcttgctcaccggtggaccagctccgatgccaggaggccctcgggactgctcccagactcccctgcagtctgcagccctgcgcccaccacctgcttctccgtcctgcggtgggaaggaccggcctgtttcgagtgctccttccctgcacggggtccagggccagcagctccgcgccagccaggagtggtcagagaggctctgttctctggcccagcccagaccttcagaatctaacttggggtcgggggaggggtggatgaaggggagactccgggagccctggggcctgagggcgcggctcactcacccggcgggcagcgtgatatacttgtgggggatgaggccccgcatgccgttgtgctccccccgccaccagtcgctcgaggccctctcgtgcagccgcagtacgtccccccgccggaagctcagctcctgggctgtgcggcccgtgtaggcaaagcaggccacagcctccacgaccccctccaggtctggggaggagagggggtccaagctgtgggagggggtgtggacactagggtggggacagggtggggctctctgcccatcgccctcaccatcctcctgtgcgggcatctcggcttccagctccggctcattgtccgcccccaggctctccagctgggcgtccctgaggttcagggcagagcgaggcagatgaggggggctcttctccagtggaccccccagtcccctcggcagcaccaagggtgtaccccaggcagctggcggaaggcggtgccatgcacttctcgtagacggggccaggcagcgaggtcaggggcgggaagacccgatcgggctgcactatgagcgtctgcaccagctggttcacccggccctgcagcgccaccgggtcctgcccagcgggcaccggtagcagcgtgggcccgaagcacacggccaggttgtaggggtccatcatgttctcatcgctgtactgggccaggctggggggacacgcacatcacaagcagagagcccgcaccccgagtccccctgtcccctcgacccctggcccccaccccagcactcgccccgcagcactcactggttgaggaaggtgaagaggtagcgcagaaccaccagcaccggcgcgggcagccgccacagcaggcggctcacgtgctccaccctctccgctgtggcctccagctctgtggccaaagccgcccagagagagccgcgtgagcggggctgccccagcaagtgccctaccccgccagcctcaggccccagcctcacccgaagaagccagcagctcgccgaacaggtctggggggaagagtgggggctccaggctccggaagtagagcttcagcaccccggccaccgagtccaggtcatgggcagtgcagccctccaccagtgggtcctcccctgcagatgggcgagtggtgcggtagggggaggaagctggtgacatctgcccgagcccccacccccgcccgccctgcccgtccccacctctctcgaaggcatcacggatctctgagacccggagctgggcacccgatacccggaagatgccttcatgctgcaggcctgtgggaggacaaggagctggtgggcactgagcatcttccccagcccctccaggatggcctcccatgccaggtgctgggaactgggtgctgggtgccaggacatcgggaggggctgggtcctgcttaccattgaggttgatgaagcgaatgcagctctccaccaccaggggcacaggctggcctgagctctggggacagagggtgtttacttcaccatggacacagcatgccctgtgttgtcattcaattgctttttttttttttttttttttttgagacaaggtctcactctgtcacccaggctgaagtgcactggcgtgatctcggctcactgtagcctcagcttcctgggctcaagtgatactcctgcctcaagctccccaatggtgggattacaggcatgagccaccgcaccaggctgagtgcttttattttctctgaagaacacatcatcgttgtcggcacagaggcttagcacaccgtttgttagatccactcgtaggtgtctgatatttttgatgaggttttaggcagtgccttacgttgtatttgcaaattgttgctggaatatacaaatgcaattgaattctgtacaccaatcttgaatcaagtaacatttcaaaactcaagctgggtgtggtggctcatgcctgtaatcccagcactttgggaggccaagggaggaggatcacctgaggtcagaagttcgagaccaacctgaccaacacggtgaaacctcacctctactaaaaatataaaaattagccaggtgtgatggtgcacacagctacttgggaggctgaggcatgagaatcgcttgaaccccagcaggtgggaggtgaaggttgcagggagctgagatcgtgccactgcactccagcctgggcaacagtgcaagaaccagtctcaacaaataaaaaaaaaaaaaaaaagaaagaaactcaaagtgctcgtttaaagaatctgttgattcttttgaatatgctacacgcataaccacatcactgaaaatgacgatatcagttctgatcttctggtattctccatgcctggccctctctgatgcttgcttgcttcttttcttttctttctctctcttttccttccttccttctttccttccctctctctctctctctttctttctttcactgggattacaggcacgtgccaccatgcctggctaatttttgtatttttagtagagacggggtttcaccatgttgcccaggctggtctcgaacacctgggctgaagggatctgcccacctcagcctcccaaagagctgggattacaggtgtgagccaccgtgcctggccccctctgatgctttctgatctcagtattagttttctgatctttcttgcttccccttatttcactgtccaggacccccagtaccatgctggccagaagtcgcaggggagaagctctcaatatctcgcccctaaaaatgccgctgccccaggttttctatacgttcccattactagttaaggatgctcccttcaatcagcggaggctataggggagcccaacagtggcctggaagaggcccacccagaaaaggacagttgatgactgattgagagtggaggaccctgggatcaggcagctgctccggccactgaggtgacccagagctgaagaaagatcagcatgtacaggtgggctggcatgtggggcaaagctagtacctggataaacttctccatgtctcccccaaagagtctctggttatactgggagctggggcggggctggcggctcttctggaattttctctgtgtgtactgggtcctgcagtgaatgggagctggctctgagggggccaggtgtggagaatagggtgccccaccccccaggccagccaagccggcctctaattctctgaagttattccacaatccagtgcgaaaactggggaagtgaggcccaggggattgggcagctgagctgggccccaggaagagaagagatggcggaccgtcgcagggccccagccctcagggaggactcaccaagacacctcctgctcctccttgtcacctgtggggtgggagaacattggtctgcctctcgggccaggggtcttcaaggcatcccagagagaaaggtgtggataagagccaaggacaggcgggaggggaggaccgtgggctagacagggtcctgggcaggggagaggcggggaagggggcagcactgggcccacctcgctgaagggcctcctgcagcttctcgtgcttggcctgcagcttggcgaggatgctccgtccactcagatactcctggagcttctgggcagccccaagaagagccccaagtgttagccctggcttgagcccctccctctgccccagcaatgcccccacgggtcccgcccaccagcccagccctccccaccgtgaggtagaaggtttcggtctcctgctgctggccgcgcctccggcccgcctgccggctgcctgggtctgagctggtggacttgagggactcggtggaggggctggtctggaaggaatcaagcacatccccgtcatccgaggccaccacctccagcagggcctgcagtgtcgccttcagagtcttgttcacctgcagaggagaccacaccagggtggtaagaggtgggggacagggagggagacaggaagtccaagtcagaaggaaggggccaaagggaggggggcaggcagggcagccacttccaacagcaggctgtacaggctccaggccctcgtctccctctaacccccggtgggctgcccagacctcctctgtctcaatggtctgtcggtccaggcggctctggatgttctgggctctgggcagaatctcgtcccgcagctccatttcaacgcagatctcagccacctgcagagggcggcggccagggggctaagggctgggcttgggcagtaggtgccaagatccccggggcataagggaagcaagcacccttttgtggcctggcggccgggcacaggaccaccagcccagacgctcagctgaagaatggcaggagtgaacacacgtgtccaaaccaagacttgtccacagaggttcgtggcggcaccactcatccaactgacggatggctaaactcagcgcggtctacccacagaatggaagaggattcagccacgagaaggaatgaatccacttatgtgaagtgtccagccaggcaaatccatagagacaggaagcagagtgggtgccagctggagcagtggggtgccagtggggctggagaggagaacggggagtagtggctcctttaggggtgacaaaaatgttctggaattacatggtgatggctgcacaaccaccaaattgtacactttacagtgctgaattttatggtatatgaatcgtaccttaataaaactctatttaaaacagaatggtggcccggcgcagtggctcacgcctctaatccaagcactttgggaggctgaggcggatggattatctgaactcaggagttggagaccagcctggccaacacggtgaaaccctgtctccgctaaaaatacaaaaaattaactgggcacggtggcatgcgcctgtagtcccagctacttgggaggctgaggcaggggaatcgcttgaacccgggaggcggaggttgcagtgagccaagatggagccattgcactccagcctgggcgacagagcgagacgccatctcaaaataaaataaaatgaaatagaatggtaaggaagactggggtctgagacagaacagggagagcccagccccacctcttccagggaaaggagtggacggaaaaactgctcactgtaactgggcagacataaatttccctgtggcaagatgagagcagcttgcctcatgggcagagtgggagccaacgctttagaaaggaaggaattactcttttaagcatgtagacatctagaaaattgacattacagttaaaattgagagtgaggattcagctgtggctaaacacttgccctgctctccatctccaccaagccccgccgtacaggactgcatgaaggcgcaagtcacagagtagaaagtaaggccattttgagatgggctccaacatggctgacccttgaggacatgggactcagtgaaaggagccagtcacagaaaggcccgcactgtaggattccactcctgtgaggggcctcaaaggagagccgtgaactctgtagagacggacagtggaagggtgggtgccagggctggggggtggggagttggggttgaacggggccagagcttcagtttgggaagatgaacaagttctgcggctggatggtggtgatggctgcacagcaccgtgaatgtgcttctgcccctgggccgcacacttacaaatggtgaacgtggtatgttttatgctatgtgtattctgccacacctttttttaaaagtccatctaggctggactggctcacacctgcaatcccagcactttgggaggccgaggcgggtggatcacttgagcccaggagtttgagaccagccttggcaatatggtaaaaccctgactctaccaaaaatacaaaaattaccctgtctcataacctggtctcaaaataaataaataaataagtaggttaaaaataattgtttttaaagtacaaatcttagccacgcatggtggcatgcacctatagtcccagctactcaggaggaggctcaggcaggaggatggcttgagcccaggagttggaggctgcagtgagctatgatcacaccactgtactccagcctggacaacagagccagaccctctctctagagaaaaaataagtgtatgcatactctggggaacattgaaattttatccctcctctaaactcacacgatcagcagaaaactaacaatttgctctctggaaaggatatagcagggattttggactcagggacactggtcccagatgaggaagatgagagaacacagcagccccaccatcggaagctggcctggtcctatcagcccggcctcagtgctgtcctgctgaacaccggaaatgacccagagcatcaacatcaggcaaggccactgtgtgaccttgatgggcgaagacagaaacaagaccactctgcgatcacgcatgagtgaggacaaaatcaagaacttcttccgagccacaaaatcatccctccatcctggctaatgtaagtgactgtcacttccttgcatcacttcagcctccatcactgtctctttctagataagattaatcaagacatccaatcatacaattaccctgcttccagaaggcatccaatccaggaccaagccccacttacctgggccctcccccagatcccctaaggcaagcccaagtcctctaaggcctttccactaccctctcactgagaggccccaggctccccacggagcagggctccctccagcaatggagattatagggctgttcctgctaggctttggctggagggtgtggaactaaaaccaggtagttccaaggaaatccacacagcagagtgagcccccagccctctcaccccctctcctccctagacagggtcagaagagtttctactggggaaactggccgggccaggaggaaacaccacagacacccacatttgtggggtatgtgttcaggcctcttcttaaatatgaactgatggccaagaatcaccaaacagacacgatcagcagaaaactaactatttgctctctggaaaggatatagcagggattttggactcacgaacaaaagcaagaaaatagagcaaatgcaggaacaggagaaaacaaaaaacatttcaggccgggcatggtggctcacgcctgtaatcccagcactttgggaggctgaggcaagcagatcacctgaagtcaggagttcgagacaagcctggccaacatggtgaaaccctgtctctactaaaaaataaaaataaaagggtcgggcacggtggcccacacctgtaatcccagcactttgggaggccgaggcaggcggatcacctgaggtcaggagttcaagaccagcctggacaatatggtgaaaccctgtctctacttaaaatacaaaaatcagccaggcgtggtggcgggcacctgtagtcccagctactcaggaggctgaggcaggagaattgcttgaacctgggaggcagaggttgcagtgagccgacattgcgccactgcactctagcctgggcgacagagaaagagtctgtctcaaaaaataaataaataaaataaattaaatttaaaaaattaaaaaattagccaggtgtggtggcaagtgcctgtaattccagctactcgggaggctgaggcaggagaatcacttgaacccaggaggcgaagtttgcagtgggtcaagatcgtgccactgcactccagcctgggcgacaagggggaaactccatctcaaaaaaaataaaagcttcagaaagattcaagaagtactgtattcatgaaataagaataaagggttggccgggcacagtggcacacctgtaatcccagcactttgggaggccgaggcaggccaattgcttgagcccaggagtttgagaccagcctgggcaacatggtgaaactcccttgctacaaaatatagaaaaattagcctggcgttgtagtgcaggcctgtagtcccagctacttgggaagctgagatgggaggaccagaaggttgcatctgcagtgagctgagatcacatcacacccctgcactccagccgaggggacagagtgagaccctgtttcaaaaacaaaacacaacaaaacaaaacaaagaatacagacattttcagatgtgcaaagtcaggaaacccttggtgaaggtgtcaccaaaataagggtatcaaactaagaaagctgctgccgtggaatccggaaacagagcactgggcagaagtgaagcactccagactggaaggctctgggggagggcgcagaggagaaggttgacctcacaggtgcctggtgtggaggacagtgctgggacgaggtagcgatcaactcctagcaatgggcatgttctagcaagcagcattcctgaggcaagagagttataaattccagaagaaaaggaaaaattgtccaaggaaggacatgtgatcctaatacagtacatggctcagctgccaacagtacctgttgtcatggtgatttaaacattgaatgttaatttagccaaaaattctgggataagcccactgggagaacaagatgcagggaagcgtgtggtggctgtgagagatgctggtggcactgggtcatcattggccaatggaaaatggctgcttgacaccgggaggtgggtggctgtttctgggggtgggagctgggaacgggaggggtgggttagggagcagctgtgacgccatcggaagccctggtgatgccggactcttcgtaaagttccaagtcggcccgaaaggggcccaatgtaatcccagatcattgacaatgcccatcaggataaactgctgcaggaaaaactagctcgacggagaaggataaagaagccccattccatcttactgccaagtttgtgtcacgaaatttaaaaacacagagaaaccagcctagaacaatgtatgggcagctacacggctgcctgctgcacggtttgaacagttagtgtcttgccctccttggccattgcgggggtgcacccttggagtgaggctgcaaatggaagtgggacacttctctagctgccgcactgcctgagaccatggagaacttggattcctgagcaaagtgtgggtcatgccactccactgcccaccattacagtgaaggccagagaatgccaagcccagcagggggtgaccctcacctcatccccatcatgggggtggtagtcaaagcgcagcgggggacagaagacggtagcatgcacctcgagaaccttggctttgtcccctggaggatccagggcctccacagcttcttccaggctgcccaggccctgcacttgggaggcttgggtgcggctctcagcggccgtgtagctccggagcacctgccccagggccaggtggaaccctgtgtcacagcactgaggaggaaacaaggagatgcttgggtaggtcctggagccacagcttcccagccccgaggcaccaggcaccttttcccacctgcccaccaaggactcacgtccatgaggtccaagacgtcatgcaggtagtagttactgacagcagcgttgacactagccaggctaagcaggtactcgttgcgcgcctttgtgcacttgagtttgtgctccatgaacttggcctgccgctactcaagacaatgcaagcgtgccagggtcacgcacgtggccagcccctatctctagcctttcatgtaatgcccatcgcctcccctcccactgtggacaactacacctgaactggtcaagcccagaagtcctgctgccttccccacgccacagtccacagtgtgctcagcccagtgccaggaggtgacttgattccccggctgttcacccgccacttgccttggttcgagccacaacattccccacagaagtgggggatgacacagaactattcacagatacctgatgagtggaaggtgcgcacatggcaccccaccatggagggtgcacgagaaacccagcttggagccagcacacaggtgcacagctggaagcggccacaggcctctgcgggggccagagctgagggggaacgagtaccccaaagggtagggatagatcatcaagagccatgaaacagaacctgctggcacctgggttctaaaactggcactctattttttttttattttttttttttgagacagagtctcgctctgtcgcccaggctggagtacagtggtgcaatcttagatcactgcaacctccgcctgctgtgttcaagtgattctcccgcctcagcctcccaagtagctgggatgacaggcacccgccatcatgcccggctaatttttgtatttttagtagagatggggtttcaccatgttggccacactgatcttgaactcctgacttcgtgatccacccacctcagcctcccaaaatgctaggattacaggcgtgagtcaccgcacctggctaaagctggcacgctaaccacagcagccagggagaccttcccccaacacagccaaactctgtcatttcccctaagaacacctgagatgctcgactccctcctctgctcccagagtcccagagaccatgactgtcagccacgcacagcctggcggctccatccaggcatttcccagcctccccactctctgtactgggctcacctcgaaggccctttctccgtgcgtgtcaccccatcacccaccctaagtgtcttcttgcccccctctgaaaccttacggaatggctggcagaacagcagagctgcaggggccccgctgggagcatggagaggctgcatggggctgtccagggccaggcaactgttttccccactctctcaggccctgggagccttccgtatggaatccctggaacctgatggcactgtcctgccactcctgccctcccctgcacccagccctgacttccccctcagcacagcaggtcctagttagggcccatggcccataggcctgcgtctgaggtgccctccaggcccaccttctccaccagcctccctcccttcttgagggagctcttgcggaggggccctgcctcagtggcaccagcggtggtggtggggacactccggcctgcccgcttctcctcctgccgctcggcctcccggagcttggcctcggcattcacgctctccatgtgatatgcctggtacgtcttcttggcctgcagggagacccaaagcaaggtggtgctggtgaaggccacggctgggccagcccccagccctctacccctgcccctctggaacttggacctcagagctgggcgatcccatgtgagcacttagcctaacgccctgtgcctagggagagaggcctttgcccctaggtgcgtgcttctccctgagcctggcttggggtgatgtgatggtctggcggtgttcctccccactgtgagtggcatttctccctggaccattggggcaggcccctccccagccctttcctcaccgtctggagctctgagaccacctccaggagctcatcctgcagctgctgctccagatccctgctctagaggcagaggcaagggtgagcacggcactgcccagagcggccccgccaggcactggaagctctgcccagatcaagccccatcgggggggcacacaggttcgctctgcctgctccccacctggcctccagtgccctcccagccacagtgcctcctgatcccaaagcctcgaacacttcccgtggcccaggatgagagcctcaccttcttgaccaggcgccccacgtcctctgcaatgtgactcaggcgctgggccaggggcccggccagcacctcactcagggccgcgctctcccggctctgctgccgcgtgtgctgcagcagcaccgcccagcagtgcaagggcgacaggagggacggctccttcctgggggtagaggggcactgagacctgggagcggagcttgggccctgccgtggcccccctgccagcacatcacctaccggaagctttggtgctcccggctgctccccaggcggcctccacggctggagaagcgctcggccagcttttccaggccccgggagtattccagctccacctcagcgcggcgccgcatgaactctgccagctcctgcagcaactcccgccgcagctcgccctgcagctccaggcagcgcagctgctcgctcagctgccagcgcatctctgtggggggaaccatggctcaggcctggtcagcacgccctgcctgggtcagccaggccagcgtgggatgggagaggcagaggcacacagaccccagtcccgtcggctctgagggctccttcggacccagcctaggctgagggcaagagctaagaggggaggaaagaagctaggcccctgcaggcagatctggcctcagctgtccagccgacctctgcgctgaggccaacagatggccagagccacccggttgagggggaaggggaagggtgtcccagagagaggggagagccgccccagcgccagccaggcacctttcagtttggcttcctgtctctccctcgttcctggaaagcctctgaatggtttcccctgcgacttcctttcccgccggtacccaggctccgggaggtggcagcctcccttgcaaacacacggatacacaacacacagatcacagtgctgctcagggcaagcctgcagcgatctcgcagtctcagtggctggggaagcctgccctcaggccccaggggaaaggacagtccacagtgagggctgggagccagggagagctgatccggccttgtaagtgaaagaatggggcagggagctagcccccgtcttctgaccccacttcccactcccaatcaccccccgccccacctgtgcattcccccaccctgcagagagagtcacacccagggccccatactgccggccttttgacaccctatcactggcttgatttggcaacgctgcttcccccacacaggcctgaagcaaagaagtgcctgtccagcaagtttaagcaacctgcggaagacacttttgccatctcctgagtgcccgtcccgagtaaataagatgctagctcagcttctggccagcaggctgcccacctactcatctccatccacatccccagggagggacatgaattgatgtcttcattcagcagaatgttgattatgcacccattctgtggcaggcacgttttaaatacaaaggcaaagaggtttgaccaagtgtctgccctcttggagctgggattggaatggggcacgaacacatatcagaatgcccaggagtgatgggtgcggagaagatgaacccacaaagcaagatcagagccaggggtgggtggggacagggaggacctctttttaaaggagggtggtcaagaacaagccgcatcgttggagcagaaggctggagctggctgtacgtgggcagtagggggagtccgagagaccggtagggacagatggcacagagcccggggtctgggcagagctcccagctggactccgagtgagagaggagccacagtagtggggtgatgtggtccagcttcgttttcagggccccctcacactgccaggtggagcccaggtggcagctactgtgctagtccaggcaaaagacggcaggattcagaccagcagcagcgagggaggactccgctgagaagagctcaatcccattggatttctgtcccgccagtgacttcccaggggctgttgcatggggaccctgtgggttccgcctgcccagcatccctacctcctcccctgatctcctattggagaatgtccccttcctagtctcagcccccttgactccaggtgccccagccctggctgcatgcgtcacccatccctctgtccctccactccctgcccccaccagactagccaggtgagggacccaggagcctgacccttccaattgaattactgaacaggagagctcttcccaccggcagatcaagctgggtaagtggaagcctggggcacgggacctcccgacagagcagggcagagcccacgatgccaagtgagacagatggagagtgtcttcatcctatccgaggctggcctcctgtggttaactcgtcagctccaaggccaggtggggtgggcgctaatgccatttgaaatcaggagagtcctcactgaatcagtttaacgttttgttttgattttttgttttgagacggaggatgttgcccaggctggagtacagtggtgcgatctcggctcactgcaacctccgcctcccgggttcaagcgattctcccgcctcagcctcccgagtagctgggactacaggggcgcaccaccacacccagctaatttttgtatttttagtagagacagggtttcatcatgttggccagactgggtcttgaactcctgacctcaggtgatccgcccgcctcggcctcccaaagtgctgggattacagacgtgagccaccacgcctggcccagtttaacattttttgataaaagtaaatttcatttcattccaagaaaggtgttagacaactgctcgcctcactggccctctggagcctgccctgccctgcttcccccagaggaatacaatccctggggacttatgacaactgaacagtgcagaaggaaccagcagagggaaccgctgcctttcttcatcactgccggcagcaaaagctgactggaagccatgtcctagtccagatccgggcatgcacaccggctggtgttgagcaggcaacttgtgaattgcaagtcgattgcattggtggctttcctggcagagctttcggatctcagttcagacaaactcgtcagcacaccctgtcctgacctccccctaaactagggctggccctcttccgaccccttcttggcaccgtgcactttccttccctttgtagtgcttattatcataatgcaaagtctatgtctcccccactagacccgtgagccatgtgagggcggggtggccactgacgccatttgaaatcaggggagtcctcattgaatcattgcttttactctgggtaaaaagccagggctggaggggctggagtcggggttctctctggtacagcagtatactcccagggcctgggacagcacagatgtataggaaacatctggcaaaaggagagctggaatccatgtctgcctgaattacagagctgggccccgggccccaccagcacttcctgtgagcaaggcatttggtctcacttctgctgacaagcaaaacagaagaaaagatggtctccaaaaccaccgctatgctgacctttgagaatttagggtgtcaagacagtgaccccactttgtagaatggtaggaagcttttccagggtgtgggatgcagacccagagcaagtgaggaacccttagacagtcgtgctcgaaaccccaacttttcagtgtgaaatcactgacccatatttgctgactgaagttttccaagtctttcagcttcatggcattttggggaagcaggatggagatcattacctccatctgagcaagatgatggcgaggcttggaaagctggctcaccctgtgtagtcacctcaagctggctctggacacaggctgccttttccaaaggaggactggagcatactttggtataaattgcttgcactgaataatgatgttagaacctacatctctgggttcaaaggcacttcaagggtcattgcattctacgtcctagaagttgcagtgctgtatgaccacgggcaagtcactgcacctctctgagcttgtttccgtaattggtaaaatggagtgattgagagtgatatggacgagctgctggcactgagctgctgcctctttcctttgcaagagttaccatgccctgaataagatgggcacaagctattggctaagaatttgcaaagctgatttgcatgtgatttgcacatgggtgtttatcagaacccagaggttcaatttcagaaggctgagaagccagccctgttaaatctctcaaccaagactcactgcgccagcttgacccagagacagtggccctcgcctctgctccccctcagtgctaaagggaggcaaaaggtgctgaagctccagggactgcagtggggttacggccaggtgatctccaccaatccactcacccggactcccttactcaccccccagcccaatcaagctggttgacttcactgtagctaaaatactgccttctgaggggcacgttgggtgcatctggctctcttttaccagcggccaccagtgtctccactgaaccttgggtgagaagcggtagacccaaggaggacagagaccaaaggaaggaagacaggaaagaaggaagggaaaatggcaggcggttgaggccaaatgggcgtcgggaggcaggcaaggggctcaggctccctcctccacccccgctccagaggtcgctggggagagcatcgggccctgggccagcgcggggacgcttggagctccctcacgaccttgggttctccgcaggaaacgggccgggagcgcccggcgccctctcacctttgacttgcgtctcatactcagcctgcagcccccgctcccgccgcagcttcccgtgagcggccatggcggcctcgcggccgcgccgtcgaaccccactgctcccacgcggccgtgagcgggcccggcgccgggacttgggggcgctgcggccagcaccctgcgcgggctccgcccagccccgcccccagcgcggctcccggtggggcggggcggcccagggctggcactgcccgcgaggggctcctgggggggcagggcgccccttccagccccactgtgccccggccttgccgtcccctcccattgggcctgcacctaggctgccttgtgcccaaagccccgctgccaagcagccggagcaggtgtgagagccccaacgtaagctggcatcccaggctgccatcccaccacctccagaaggctgtccctggtcaccactgccagactgtaccattcacagcggggccgctggcccactgtaccagtggccatgaacaccattgctgccccaggctctggactccccctgggttgcctccttcccccagacatccgatggggtcctcccttcccaagtcagcccccagagaggcccagggagccccagggagccttgagagctggggtgggaagttcagaggggagggggaaggaaggtcagcaccagagagcagaacctcagcagctggctgccgttccctccaggcccccttggtaggggaggagagttcagctccggttccccttctgctcagccccacaatttccccataggcggttaccacttcctgctgccggaagagactgctctgcctcccttcccctgcagctgcacctgcccgtcataggcctgaggggggcagccccctcggagtgaggtcttagctaccctgggggcaagtcttggggcccccctcatccaggggtggtggggctttcctccaccctctaccacagggcagcagcttttctccgggaaatcgggaaggcgggaggcgggaggcggttgacaagccaagcagacaactggcttcaatttggtgggagggaaatccctggggtatagatgtggggagagaggcaaggcacttgggcaccaggcgtgtgttccgaaggcgggcgtgggggcactagtgcaggggtactaggcgtgtgtgtgcacggatgtcagagtcaggctctgtgcaaatgcgggcacacatgaccttgacctgcagatctggggaggggaggctgtgcgggtacttcctgcctttcaactgtgagcaattaattctcttgcccagaaggaaaaaaacactccctcagctccccgcccccttctcccagtaccaaggcccttctcgaacacgtcgtcgtgtgtgtctgcaggacctggggcttcaaggcctgggagctagccagacccaggacctggacttccagcagctggtctcggaagtaccgatgttcgagtcctccagcgagactagagagcctgcgcccctgcccacagcgcgtacagccgcacccacactccaacctgctcctggtcgggagactcacacgtcccaccgctgcctcaggccaaggggaaccagggagccccgcctctcactagctggccccaacacatcttgcccctccatccgagccctgactggtccccaaaggtccctccacccagcagagccagccacagggctcaggcaggcaggaaaggcctcagccggtgccttcaaacgctctcttcactccttttttcactccagagctattcctaggatgccccattcagcccgtactttagggcctgagtgttgggccctggcttttagggcacttgtttggcatttaaggccctgaacgcaactgccccctgctgctccgtctatccttcgctccattgttccccttcaaagcatccaaaagccaggcagcccgcagaaggcgcggacctgcccgcatggggacggaggctcagcggccgacaggcatcgggcccgccggggacggacggcagagggcgggccgggtcccatgggcctggccggggcggaaggagggcgccgcgggcgccgtgggagcctgggacacctcccttccaccggtgccggggcgcggccgacgcagtgcgcaagcccgcccttcccccgcaccctgcgcgcgagcccagtgccgccggaccaatcagagcctgggaacgaacctcgccgcgggcttgcgaaccggaagacactgccgccaggcgcggggcgggacaggactccgcctccggcccatacaaagggaagcccacgtcttaagccaatcaacacagcctcgcccgagccgggaagcggagagctgtgggcgtgcgcagacgcgcctttccggccccggccccgccctgccgcgctctgggctccgcttccacagctgccggctgcctgctggtcacgtgcgaggcgccagccaaagagaaccgagctccaggcctgtgtggcgagttttcaacccggcggaggagcagtgtgccacctgcagtagcaggacacagagagggctcaggaatacagggcccgcccaggactagggacagtaaatgatggctttgcagccggaggggagggaagggaaaggaggaaagacacagaaacgagcgttacggttagggtgactccatgaaaaacaggattttgatatatatgtgtatatgtatatatatatgtatatatatattttttttttttgagacgggtctctgtccctggagtgtggtggcatgatcagggcccacagcaacctccacctcccgggctcaagcgatcctcctgcttcagcctcccgagtagctgggattacaggcatgcaccaccacacccgggtaagttttctatttttagtaaagatggggtttcgccatgctgcccaggctggtctccaactcctgagctcaagtgatcccgcccaccttggcctcccaaagtgctgtgattacaggcatgagccaccgcacccaacagccgcccagttttgtattttgcatgaaattgttaatgagggaatacatggctttatgcatttgtgtaaccccatagaaactgtacaacacagacaggaaacctactgtaaaccatgggctgtagtttacaataacttatcagtattggcgcatcaacaataacaaatacaccaactaatacaaaatgtcaatggggaaacgcggggaattgtactaaaaataaattattttcaaatgcaaactcaggttagggagtagactcaagaggtatcatggactcactgaccattagggtggcaggggagggaggactcaaggactgttgatggggcatctggctgggtcattactcagacaggacatttgtagataagcccaatgagcagttggatgtccacatctggagcccacgggtatgctggggagctgctgtagcccgaagcaggtgtgattagggagagaaagtctgaaggtgaaggtgggaagagaactgaaggccaccaagagtgggagccctgctgttgagctttgagcctgagcagccccggcttgtgccacaaaacacattcagcgtggccaagcagacctccaaggcagggtctctcccataagtccagggcctccttccccggggccacagctgctgaaggtcatgagactagggagtcccacctccaaagctctttccttgtactcgggcctggcaggatgctctgggtcaaaaggccaaggctcacatccccaccagaggacctggagaaacacaccctctaaatgtgcgcgcgctcacacacaaagttccccagtgccacggagcgaatttattgtgaaagctcgtggggtgaggaggggatggggcaggctctaggaggctgagtcggaggcctctgagctgtccttgacatctgtgctctctgtggtctcgctgacctcgctgaggtccttgctgtccccaccactatcctcggcagccaggcccttctcctcgcgacaggcctctcctgagctcggaggtgaattgcctttgctctccaccttgttctcgatggcacccagcaccacgtgcctgcccttctctttcagctccaggtgccgcctcagctgccaccaggaacccagggagaagcgggggcaaagagacagggcctaagtttccagacaaagggagcctggccctgtcgctggctgaggagaggggcatagtgaggcagcagggctaggcaggacacgcgggactgagtggggacacctggctggagccccagtccaccgctacctgggcttaccgactaccatggaggcccccacgacagagcgctgccccttgaccagccctgccacccgatgagccttgggcagaaccctgactcagaactacctttgagcaggcaggccacccactggtccctagacctccccacttcccttctaaaagcctcctccctctgcctctcccatcaccctccaggctgctaggcagatggcctcctctaaagcccagcctaggaaactgaggtcgtgactcctggcaacgtagccacaagagctggcatccaaagtcggtctcgcctgcagccactgtcttggggctcctgagtgccgcccccgctcgccttgcttggcttcatgcaggcgcttacctcgtcggccatctgagtgaggtcccgcttcatggcataggcgtcctccccatctgcatagtatttgggctccacttcactgatcctgggggcagagggttagagagcaaggaggaagacctgtatcccggggacaccctcctccactcctggtatcgtggctactggagcaaggtgccatgttttctccctgaaggctccatcctgagacaacaagtccagtgtgacctgccctctgttctctccagcaaaggctccaggacacagcggcccgccccacccgtcctgcccccgttctgtgtccttagcctggatactaaggatccatttctgcggtttcttgtgagctgaagccctgaattcagccttccccttccctccctgccctgcgccctgtcccttactgagctgcctcacaacagccatcagaacccaggaaagacggtgagccctgcctgagcagctctggggccgtgactacactgggcaggtgtgtgtgcagactcgcgtggccatgtccctggaaggggagctggactcaatggcctaggctggccctgccaggcctaagacatgaggattgctgacttagctataaagcaattcccaccagacatcgtcatctgggtcacagatccctcttgccagcatccagcccagaggccaccgcccttcccaacagtccctcttcttcatcccctaccaaacgggctgagtgcagttagtgtccctccacaggcagcccaccccagcttcacttgcaagcacttttttccactgtctactgggcatgccaactgccaggttctctctagtgtgctaggcacacggggcctcctggtcctcaggcagacctcccccatccactaggctgcctggccactggcccttccttcctgaatgtgcattctcctcgattctgctctctcttggattcttctaggtgcttggtcatgcttgagtcctgctcctcagcatctgctcacgccagggacccacacctctctattcccaaacattactaaacagcccgtgtgcccttcgccagcctcagccatcatgggccagagctcctccatcacaacacatggagcacgtttcagcaggcaggtgctgtctccatgccggcttttcaaccatcagccgccgagtgaatgtggaggtatcctggcagtgctggggtccacagcctcttccccacagccggcccacccccgacctggaaggcaactcagccggtctcaggtgccctgatgggccagacctgggatcaaccccagcccattagaaaaatcgagatctacttactgaaagttgagggtgttggaatagaggtgcagggcggcccggttactgcaggggaacaaggcactgctgagctgcacggatttggccagggaggggtagcacgtccaggtcttgcccctcctcctggtccctccttccccccaatcccacttcctggatcttcaccaaaagctgaggtaccccaggacccccgtcaaggcagtatctctccccctcaatcccccttccctcagcccggcttccacctcttcctgacatgcagggagacatatttggcattgaagttctctatcatggctcgagaggcctggtccatcagtttctgagccagaccgaggcgccggtgggaacgcttcacagcctggtgggagaagagcagagatggggtgagggactgggaccttgagggctgccccaactaacccccacttccacccccaccagagagcctgggtggaccttacataccaatgaggtgatatgtccatggggcacatcatctgggtcctcttccctggagagggagaaaggagaggctgcaaaggagctcagtgtaggcacagccacctccagcccccctgccatttgtagagtggacatgcactacagccccctaagaccccagctgggggagagccgggagcctcttggatcagagcagccgatcctgccaccctctgctgcctgaaaaccccaagcctgccgggtgtggggcacacgcctatagttccagctacttggcaggccggggcaagaggactgcttgagcccaggagttcgagaccagcctggacaacacttttttttgtctctacaaaaaaaaaatcaaaaaattagctggatgtggtggcgcatgcctgtggtcccagctacttgggaggcagacatgagaggatcacttgagcctgggaggttgaggctgcagtgagccatgatcatgccactgcactccagcctgggcaacagagcgagaccctgtctcaaaaaataaaaaaagaaatgagctgtcaacccacgcaaagacaaggcagaagcttaaatgtgtattactaagtgaaaaaaagccagcctgaaaaagctgtatatagtatgattccaactctgtgacatcctggaaaaggcaaaaccatgcaaacagtaaaaaatcagtggttgccacgggttaaggagagggagggatgaatgcgtggaacacagtgaaactatcctgcgataatatgaaggtggacacatgtcatttggtcaaaaccatggggcttacaacacaaagagaagtgcagtaatgtaaactatgggtttagttaataataatatatcggccaggcgcagtggctcacgcctgtaatcctagcactttgggagacagaggtgggtggaaacacctgaggtcaggaattcgagaccagcctggccaacgtagtgaaaccccattgctactgaaatatacaaaaattagccaggtgtggtggcatgtgcctgtaatcccagctactaaggaggctgaggcaggagaatcgcttgaacccagggggtggaggttgcagtgagccaagatcacgcgactgcactccagcctgggcgacagggcaagactccgtctcaaataataatagtaataataataatagtaacatatcacattcatttatcacttgtcacaagtggaccacacaaatccaacatgctactaacagaggaagctggcagggaggggatgctgaggggtgctataagaactccatgtcctttctgttcaatttttctataaactttcaactgtactgaaaagaagaagcctattcattttttttaaagcccacagaggcatccaccagacacgtgtagcttctgtcttcctccttggtgactcacattttggccaggacataccccacaatcttcccattctcgtcctcagcaatgtaagagagctggtgacaggaaaacagagtgagaaaacttcttgtcggagctagaagagccctttagagggacacaaactggacgagtggcgagttgtgtgatggctcatgacctccgggctgagtggcttggtctccccctcgccacactgtgccctgcccatacccagaaagaagacgcaaagtggggatcctgcccctattctctgctcccttcgggcgccttcttttcctttgcccctgtctgccagctgaaaacacccaggacgccaccgaccatacagccccctgggctctgacagacttgtccactccctccaagatggccagatgggattttcctcggcctgctttcccccatgcccaaattcagaagctgcccacctggggccaggaaaggccatggtagaagtagtatttcatctggtagttctcgggcaggcagaggaggttgcagtgctgcatgttcattaggtcctctggctgcagggaaggagggcagtggaacgcgctcagtctaaggcggcggtgaccacgggtgagaagcctgctccccgtcggtctgctcggccccgctccctcggggctgggcaggcactgtgacgatctgactttgcacaacgcccggagcacaggaacaggagtgggcgccccggaggtccccggagcccacccaacggaggcccgacatcacgcaaacaggagggaatcgcagccccggccccgcgccccggcctcttcggcgggctgggccagccccataggtccagcggccgcaggcacactcagggccaccgggccgggctcggccggggccctcgggagcatgcgcggcagccacccggcccggcgcccacgcggcgcggacagcctcccgccccgggcgctcaccctcgcattgcggatgttcataacggcggcggggctcgcgggtcccagcggatcgtgaaggcgcagtcagctgccgccgcgctccgaagcgacgccgggacggccggggctgggaccggagctgggctcgctgggcgacggcggaaggggcggtgcgcgccgggccggccaccggccggaagtgcacggccgccgggcccgtcctcccggccgcttggccaatgcgcgggacaggccagcgcacggggcgggccaatgcgcggagccggtcagcgcggggcgggcctgggggcggggcgggcgctgccccggagctggagccggcccctccctcggcgcgacagcccccctcccgcgagcccacagacgcgcgcacagccgcaggtggagcggactcagcctttattccgcgcctcggcaggcgggggtgggggcgggggagggggcgggggcggggcggctcagcagggcgcccagcatctcctcgcacatggctaggcaccgcggcacgtggaagcagcctgcgggtagaggcgggcaggtagtgagggccgggggcagccgagaggcgcaacccctgcggccccgccctctcccccactcacctttgaaaggacctcccttgatggagagggccaccttgccctctcggctcaggtagccaaaccattccccgtactcgggatcgcgaaactggaataacagagacagtgacagctagcgcctgcaggacccgcccagatgccactgcatcgctaccaggggtcagagcctgggttgaccccaggtgacgtggctccagaaccagcgatcttaaccgcgacactgcgtcctccacaaagatgaaagcaggggtgggcgcagcaggcaggctacaactatataaccgactgggcaaggggatgagacactgctagatggaatgaaagaactctgccctggggtgtagaaacgttgtctatcgggccgggagctgtggcttgcgcctgtaatcccagcactttcggaggccgaggcgggcggatcacctgaggtcaggagttcaagatcagcctggacaacatggtgaaacctcatctctactaaaaatacaaaattagccggacgtggtggcacgcacttgtaatcccagcagtatactcgggaggctgaggcgggagaatagcttgaacacaggaggcggaggttgcagtgagctgagatcacgccattgcgctccagcctgggtgacagagcgagactccatctcaaacaaacaaacaaacgaacaaacaaacaaacaaaaaagttctctattgtgattgtagtcgtggttacgttgattcaaagaaacaaagaacccggccgggtgcaaaggctcacacctgtaatcccagcactttgggaggccgaggcgggcggatcacaaggtcaggagatcgagaccatcctggctaacacagtgaaatcccgtctctactaaaatacaaaaaattagccgggagtggtggcgggcacctgtagtcccagctactcgggaggctgaggcaggagaatggcgtgaacccgggaggcggagcttgcagtgagccaagatcgcgccactgcactccagcctgggcaacagagccagactccgtctcaaaaaaaaaaaaaaaaaaaggaaaagaaaagaaacaaagaaccctgatggaggcgacgacctgtcatgaaactcttaagaagtgactcccttggagctcccattcccggcttcacaggcctgtcttccagtagatgcacaatctcatctgactcctgtcctggctcaccattggtcccaaactcatctcctcctccctctgcccctgcccagtgcccattccactctctttccttctctctccactagcattccatggggcacctgtctcagggaggcttgtcagttcagccccttctcaaaaggatcatggactcaattacattgaagtccactatgaaaatgtctctttaaatggtggcccataagagttggtgtattcttctttgtaggaagtaaaactagtcctgggctgggcacagtggctcacgcctataatcccagcactttgagaggccgaggcgggaggatcacttgaggccaggagtttaagaccaggctgggaaacatagtgagaccccatctatacaaaaaaaaaattaaagaattagctgggcgtgatggcacacagctgtagtcccagctacctgggtggctgaggtggaaggatcgcttgagcccaggaggttgaggctgcactgagccatgattgtgccactgcactcagcctgggcgatagagaccctgtctcaaaaataaataaataaataaataaataaataaataaataaataaataaaaactagttctgtgtgtattcattctgtcttttgagttacattgttcaagtccttacttattttttgactgcttgacatgacacaggaaggtaaagaagaatttccttcaatgtctggatttttgccttctgtattctgttatgttggttgatgcataatgacttacctgtttttttgtttgttggttagttttttggtttttgtttttttaagacggagtttcgctcttgtcacccagactggatggagtgcagtggcgtgatcccagctcactgcaaccttcacctcccaggttccagtgattctcctgcttcagcctcctgagtagctgggattacaggcacccgccaccaagcccggctaatttatttatttattttttttattttttattttttttaatggagttttgctcctgttgcccaggctggagtgcttcccgggttcaagtgattctcctgcctcagtctccccagtagttgggattacaggcacccgccaccacacccggctaattttttgtatttttaatagagatgggggtttcaccatgtcagccaggctgttctcgaactcctgacctcaagtgatccacctgcctcggcctttcaaagtgctggaatggcaggcgtgagccaccgcgaccagcccaatttttgtatttttagtagagacggggtttcgccatgttgaccaggctggtccagaactcctgacctcaggtgatccacccgcctcagtctcccaaagtgctgagattacaggcatgagccaccatgcccagccgatttacctgttgattataacttttgtaattgtttaatgtcatctatatcttattaaaatgtattccttcaatttcatttttgagttagaactggtggcccctaacacacactctatgaatgcattaaatattaagatatagctgcaggtctaacaaccctgctgctttggaagtagtgacgaatatatgtgatacttgcagatgtctctctaactgcaatgcaatgtaaacacatctggatttctatcggtgacaaagccaggcacttctattaccaatgtggttcattgcctccactcataatggcagcaaatgctagtttcagttagaggttagtacaaataaagatgtgattctccgcccccggtttcgaagctcacagaccccagaataagatcccctgctatagtcctcgcagtaccagggttcaccagtggagtcggagtcgtggctttagaaacgcatgatgaatcttcattcattcaccacccaggccttgccaccactgggtgccatgccctttccactgggtgccatgccctttccactgggtgccatgccctttcctgtgttcagcagctcgagttgcctcctgggcagcagtcaagacagcttatcactctgctcctagcacttgggcttcagggagcccctggcttggttttcttcctgcgtcaccactgattcttgtctcctttgctgggcccccatttccctttttgcctcatagatctcagcagcatctgtactgtttttttttttttgttttttttttttttgagaccaagtcttgctcttgtcccccaggctggagtgcaatggtgcgatctcggctcactgcaacctctgcctcctgggttcaagcgattctcctgcctctgcctcccaagtagctgggattacaggcacccaccaccacgcttggctaatttttgtatttttagtagagatggggtttcaccatgttggccaggctggtcttgaactcctgacctcaggtgatccacctgcctcagtctcccaaagtgctgggattacaggcgtgagccaccgtgcccggccttttttttttgagacatagtctcgctctgttgcccagcccaggctggagtgcagtggtgtgatcataactcattgcagcctcaaactgggcttaagcagtcctcctgcctcagcctcctgagtagctaggactacaggtgtgcatgacacccagctaattttttaaaattttttgtagagaccaggtctcgttatgttgcccagactggttttgaagtcctcggttcaagcgatcctcccgtctcagcctgccaaagtgctaggattatagacatgagccactgtgccaggcagcatctacattcttgtgatactgaaaacattcatggtgagtccagatctctccgtctgaactggagactcaggaatcccactgctgctccaccagactgtgaaccctctgtccccaccagctcccacctgggccagccctcactggctgggatgacagctacagcttcctctgctgtcccagcttctgccctgttccctacagacttcccccataacaccctcccctccaagccccaggacccaggtaacaatggaatcagaccaggcagctggagtccgtcccttgcccactctgcctttatcctcccgggctgccaggcccccctgctgtgccacatgccccaccctgcccagactcccagtccctcagacacacccctgattgactcggcccctgctcagtgcttccctgctgccaccccataggaaagagcccccccacaaccctctccagtggtattattcccacagctgtcactctcaccaccacctaggtctgcttgcttacactctgctcctcccgcccccaccaccaaaattcgagctctaggagggcagaggcttcttcgttgactgaacgaacagcactggggctccggaaactctcagaccagctgagcgactgtgctcagcgagggggcaagagcgcagccgggccagactccccccattcccccattcagcctctagaggggacaaggaggcagctctcacctggcggaaggtgtactcagccacttggtagaagaggcgcagcagcacagggtccccactgtcactgtaacccatgaggaaggcaatcatggcttcactgtgtggccaccagagcttcatggcccactccagctgaggggagagcaggggcaggcatctcagcaggaaactcccctccgcaactttccagacctggctgcgtctccattggcccaagctactggaggtgaattgcgggacatctttggaagttctgaaggacccctcccagtgatatcagcttcctgacctgtagattcttgaatagacaccagggccccagacgaatggcatatatgtctgagcatcagcgtttcgccagctccctggtggcctccatatgacatggtgtcagaggtgtgtaaaccagagcaactccatcttaaacaggagctgggtcaaatgaggctgagacctactgggctgcattcccagacggctgaggcattctaagtcgcaggatgagatatgaggtcggcacaaaatacaggtcataaagaccttgctgataaaacaggttgcagtaaaggagccggccaaaacccaccaaaaccaaggtggcgacaacagtgacctctgctcgtcctcacttccaacagtttacaaatgccatggcaacgtcaggaagttaccctatatggtctaaaaaggggaggcatgaataatccaccccttgtttagcatatcatcaagaaataagcataaaaatgggcaaccagccgggtgcggtggctcacgcctataatcccagcactttgggaggctgaggcgggcggatcacctgaggtcgggagttcgagaccagcctgaccaacatggagaaaccccgtctctactaaaaatacaaaattagccaggcatggtggcccatgcctgtaatcctagctactcgggaggctagggcaggagaatcgcttgaacccgggaagcagaggttgtggtgagccgagatggcgccattgcactccagcctgggcagcaagagcaaaactccacctcaaaaaaaaaaaaaaaaaaaaaaaaaaaggcaaccagcagccctcagggctgctctgcctatggagtaaccattcttttattcctttactttcttaataaacttgctttcactttgcattgcggactcgccctgaattctttcttgggcaagatccaagaaccctccctcttctggggtctggatcacgacccctttcctgtaacactggcacagaagctgagagcaggcctctaggttccaatccagccccaggttaccctctagagaagcaaccacctccctgggcagaaagccttagaacagcgtgggtcacacatggccctgggcgctctcccacctgggtggggcagaagttatcagcatcctggaagtaaaagaggcctccgtggtcagggtcccatccggagtggaagggcaacaataggaacttgtcaatcacgtgggctcgaagttcggggtcgcctttccgaatgcaatgacggagcagaaaccagccggcttccagcgtgtggcctggtgaggggtggagtacggaagggcggggggcggggggtggggttgagggagggaacagagggagcaaaagcccctggcacctctctgctccctccctaacaatgagcgaggctctgagctccctggccctggaagcctgctcctctgcagaaacccccagccttgggaagcccatcctcgctcctctgcctcctcaaggcgcccccgccaggcactcccatatctgaagcccagaacacaaggctcagcgctcccctcctcctgggtggcccccagcccaccccgcccctcacctgggttctgctgtctccccaggcagccaggaagttccttgccaccctctgacacattctccagcacagcttgtccatccctctaccgggaaggagcagaagggaatgttgcctccagccctttcacccacccagccacccaactagaaagacccagctccggaaagcccttcctccctccctcttacccaagcccctggacctgctggcttgggtgggccaggctcagaggggcatttaaggaggggctgattcactcccttgggcctagcaagttgttgttttttttttttttttttttttttagacagagtcttgctctgtcacccaggctaaagtgcagtggccgcaatctcgactcactacaatctccacctcctgggttcatgcgattctcctgcctcagcctccctagaggctgggattacaggcatgcaccaccatgcccagctaatttttgtatttttagtagagacggggtttcactatattggccaggctggtctccaactcctgacctcaggtgatccgcccgcctcagcctcccaaactgctgggattacaggcacgagccaccgcgtccagcccgggcctaggaagatgtaatcctcacttctggcctgatcctctccagcaggggagggtgaaacattgaatggggacagacagggcgggtttcacggcccagaggcctggaagggacttgggtggggcaggaggggtctccttctgtcagggcttgcctggggctccgcatcctccctccagccctcaggccctccaccttccccaggtgggacatccccgaatctctgtctctccaggtgtgtcgagccccagggtgcccaggggagtgggggagtggaaggcctcccaccaccccagctccccaggcatcccccacctgcacgtgctgcagaatcctccgggcgcaccagtcccccagctctgcgtatttgcccgccagctcctcatctgcctccccgagctgctccaccaggttcagtagcatcatgggcaccgccatgggctccgcagccggggccccctggagctggggccggcccagtcccgacgcgtcctcctgcacccagtggacgatctgatccatcatctccaccgcttccgtctgggggtgcaggaggcaaggggaggcccaggctgaggctacatcctgtgccatccccctggacacggccctggggtgggagagccaattcctctcctgaacccagagacaccttcatccagggcctacttggggcctggcacccagcgtccagtaggggccagtcagatccgccccactctgctcccagtctgggggtgcagccccttccaggctgtggggtcagggtctggcagcacagggagcccagggaggagggaagggccttttcccagttgggggcagggcgtggatagggccctctccgtctgcgcccctgtgggggtaggggagcgttcagaggtgaaggggacttggcccacagatgggtccatgggaggggacttgcgtagtgagtgggaatgcatcaggtggccatggcagggtcgcagggtggggtcttcaggggcaccctcctctcacacacctggtaccgcacttcccctgtggctctccacagctcgttcatggccatggtgtagaaacactcactgaagatggttcgctgcaccttgaccgggcggccgtcccgagtcagcacaaaggcacacttcttgccaggaggtgccacccgggcataccgcagcaagaactcaccacctggaggttggggggttggcatgccaggggtaaggccaggacgccccgcacacaccacccttgagcctccccaagtccttcgctgcttctagatccctctaggaactccgcacatgtgccctgttgagtaaacatggacggagtcactgggagatgggcaggaagggggcacctacctgcttttgctgcgtccagaagctgagcatggcggaagcgctcgaaagtgcggtacaggcgacaatacatccatacctgcggggtacgggagggaaagtggcttaagtggccggctggggtgaggtggggagacctttgaggcgatgggccgtgtgcctgagcttccaggctgggaacaccatacctgcctcccctgcagccacacatacttgaggtcatcatacacccgcccctcgcggccaaggcacgtgaagaagcccctgtgggaaggcagggttagcaaagtctggaacgggccttgccagcccctcctgcccctctggggccagcaaatctgtgaggtgcctgagagtgagaaggggcctcaggaagggcaaaaaccctgctgaggactccagaagcacgccgagtacccgtgctcctggtcgtgggagtgctccatccagaaagccaccacgcggtccagctcctgccccacgcgctccttccaggcctgcagagtctctcgctctttctccatgtcctaggggaaatggggcttgaaggcgcagcccccacatgggacctaggcccccccagcctcgggaaccagccctcagggatctccccacctctgcacggggcttcagacgtcaccatccccgggaccctccaagacagcactccccccaagcaccccaccactggcctgtcgcgctgggagacccttgctcatccctcctgctcctctaggaagccagacagagttggtcgcggtcccgtgactgtcactcagctgacacagccgcgcccggctcaccctccccctcctcttcagggttccgctgggcctggggcggggctttgagcccgacccccgcacttgttcctgccgcgaccctccactcgaatgggccagtccctccagggcccctgctgggagctctggtctcaagatcctgcttggtgggaaaagctgggatggccggagggtctgggatgagggggaacggggctgccacccaccccgccctacaccaggggccccggcagggcggctgagggccttggccctaccaagcctgtggggcaggggtgcagcaggacagggaacagctagtgggcctgaatgcagaggtccctctgacctgtcaccacacagggtagacaggaggcaagttctgtttttgttgttgttgttgttgtttgtttctttgttttttgagacagtgtcctgtcgcccaggcagctcactgcagccttgacctgccaggctcaagcgatcctcccacctcagcctcctgagtaggtgggaccacaggtgtgggccaccatgcctggctaatttttgtatttttagtggagacagggttttgcaatgttgcccaggctggtctcgaactcctaagctcaagcgatcctcctgcgtcagcctcccaaagtgctgggattacaggcgtgagccaccgcacccagcctagcaagtcctctcttttgaatcagtttgtcaccaactacctcaacagtcagtaatgggcagccattggcgctaattttttttttttttttcccaagatggggtcttgctctgtcgcccaggctggagtgcagtggcatgatcttggctcactataacctccgcttcccgggtttaagcaattctcctgcctcggcctctggagtagctgggattacaggtgcctgccaccatgcctagctaattttttttttttttttttttttttttttagtagacggtttttcaccatgttggccaggctggtctcaaattcttgacctcgtgatccacctgcctcggcctcccaaagtgttggtattacaggtgtgagccaccgcgctcggccttggcactgacttctttacacaagtgacacagctctaaggccagacagtaactgcaggtaacagcccacaccccccttctctgggcctgttttccagctgcccagatctgtctgtagctctatgactgacccgatgatgctacaaggcagctgggctgaggtggttcctaccttccaggccaacagtgcacaaaatgggttccagcctctgggcgtgggtactgcactgctggtctttgatgccacagtggctgtctcagtccctgctgcaggctgacccacccaaccccaaacagttcccctttggggtgcttggtaatgaggctgatgccctggcagctggggaggcatcctctgtgtgctcccacccaccctcggcctcggctcatgctcaggggatgagctttgtgcccagccgggctgtatctacctgccctgctcacaggcctgtcatgttcacattcatgtccagcctccctcctgcctccccagactgagtggtgccctcagacggaaacgcggtattttcagataaacaccagaggcatgactgatgtggcccttgccttgtggagtgtgatgcagccgcggtgagacaagtgagctgaaggaatgcggagggtgggtagccccacaggtgccagctacagaagtggggtaggaagaagccttgtaccacccccaccaggcgaagcgcccacaacgccatttgccaaaggtatggcaaatccgcaaggcccctcggttctggggccagccccatgtggcccctggcctccaccagccccagccatgactcctaccgctctgctctgaaggacactttcccacccctctccttgggcctctgcgaggctaggctccaaggcaggtcacagttggtgcggtgggtaagacagagccatggctcctggtgtcaagccctggccagtctgcttccccccacccccacatgacacagcagaccccacaggacagaggcttcccagaagaggtcgcattcgacagggccttgcacacacacccatgccacaggtggagacacggaggctttggttactccaggagcttctggtagcggagtgcctgggtgctctgagaggaaggctgggcagtagaggtgtgtaggggaaacaaaggcaggcggcaggggcttggagggggcggggaatgcaggtgcgccaggagcaccaggccccagaagcagggtgtcactcccctcagacccgcctaggcctgtgctgctccggccaccttgccccggagctttctgggcctcctggtacaaattcagcccacgggatcccagctgtcctaccgacccagctgctaggtggtcagtctggatcacaagctcttgcttcttcccttgggggcatggctcacatttaagaggaagccagaggaagggatccacctctgcagtacccgtggtgtacttgactcagcccacctccccccaacccacccaaggaggctgccgctggtgacctgccaggcccttgccccatcctatcctctagtgcaggaggggagggagggagatctgggccccagacacaggaagtcagcagcagctgcccaaggggctctttggcccttgccctgcaaggcagctaccaagcaacctgctggaccctggtccgacttggtccaaagaccggaggccacagcagaggcctcactctggggccttctacgctttcaccagagctcaggtctccctccagggggctcccgtgagcctcgggcaggtctcagccttcccgctcaggcttcctgagaggatgccgggacacagtgagacacctagtggttatttcaaaaaaagtcttttaattgttcaaaatagcacaaaacgacatcgcactatggtaatattgagtcacaggggttactctacaatagtgaacggtgtactctcctcagaaacaaatcaataggcgcgcgagagaagggatggggtaaaacaacaggaccaggtgagtgggctccaaggtgactaaacgtgacattttccacagcgaaatatactataatacaacaaaccagaggccctggaggacacaggctgctgcgtctccaggcagaggtcggtaggggagggctggaaagattggctgctcggttcaaatccttctgacttgctggcaagccttgctcctcgacagaagtttggggtggggggcagaaaactccaagcagatcccccagcctcggagcctggcctgagttccatgctgcacagctgctgctggtggcctgctccattgccctagcctcccttgtgggtgacactacacagtcaccctcccaagctgcctccaaggacgcctggttcccctccattctccaccctttccatgacgatttgggggaggtggagcagtggctgcggaaaccagcagccctgtttgggaggcggtgccggtggtgctcagggagggggcatggggagagctggaaatccaggacaaggaggccccagccctccctcaagctcccctaggctcgaccctatagatgcggagtgatcgcccatgaggaatgagctgtccttcctttgttccagcggcctgaggacaggcaaaagggcagagggcaggggccagcaacaggaagttgggctgggtggcaaacagcaggcccctcgtggcagatttcacacctctcctgccctggctggccccagcttttcctccagaaagatccctgccaagaattagccaagaagaaaaaagtaaaaaaacaaaaacaaaacaaaacaaaacaaaaaaaagagaaaagaaaaaagattacacattctgtacacagctaacaacaacaaaaaagggacaaaaccccacacgctaaaattacaatgaaagtgtgaacttcaccaattgcaacctaaaaaacacaacaaatgcagcagttggcagtgcggcctgcagggaggtctgcacaggcgctgcccaggccgccgcggggctccttgccccttttttctttttccttcttttcttttttaaaatgggaaagaagagggggagggtagaagaggtgggagcacaaaggcctctgagaaaatgtgtaagcttcctgtggggtcactgagcagggtgggccgggggagcctgaggaagggaagttaggtgactggaaacacaaggggaagaaaagaaaacagaaccagacacccaggccagggtgccaggaaagccactctggggagggccaagagggacgcctttcctcccctccatgcctgcccccgacctggccctcaggaacgcacagccttgggagggcggagctggctgtcctcagctccgccttccctccccgcaaaagtctctccccagggtgggcggcagcggggaggaaaggaagcgcgctcctctctctgctttcccatctgcctctgcttcctcccaacagcaatggtaaaatgtgctttctttagattattttaaaaacagagagaaagagaaaggggagaggagtgaacagcggctcgcgagggtgaagtgcgaatgctgggacggggtgggaggggtgggccctggcgggtgttcctgaagcaggggggtctggagaagaatccaggggctagtcagcttcctctcactgaccatcggccttagatttctttggagcagatttccttggaaggcagaaaaaggaaagagaaagttagtgtgggccctgcaccactggaggccctgctggtgcagggccggttaggggcccccagtcatttgacaagaggctgaacccagctatttccacccctagtctcagaaggttcccgagaggggcttcctgcttacatttctggagaggacatgggccgcttgttggctggcttggtgccagagctgtctttactggtttctggaaggaacgggagagatgcgtgagcagcattgtgacagaacgagagcaaggaacacatgcgccctgcccgcctgcagagtctcttggtgccacatggcatgacccgcagctggcaagggtggggcgcctgccctatgggtggtcaccttttacgccactccttgggaccagaacacgacaccactcactcccctctggacgtaggttagaaacccactcagctcagctcccacctctcactgccctcccaggtcccagagccccaggggagctggagcaggagcatgacctgacaggaggcaggctggcctccatccctcacctgctgcactccagggacctgggacgtgctgttttcgggcctggaaacctacactttcccgccagccctctcactgcttgtcccctcaaacatcctggggtggcgtcccctgcacccccaggcccggagctgggtcccctgctctacttgatggccacccccgtggggggctgtgtgcgcgccaaaggaagcagggagacgccgcacatgggaaaaaatctcagatggtgacagttcctcctgctgcacccggcttcctgggccttccctgtgcctgaagagctccacgaaggacactcaccctgcagccacctcacttgtgtggccgggccatagcccttctcattgcgggcggcgatgcggaagatgatggcgggcttggtggtgtagtcgatgtgggcgttggaaaggctggaggactgcaccaggcaggaggggctgggcccgcagtacacccgcatgaaggccagctgggccggggtggagctcttgagctcgcccccagcctgtgagctctggatggccaggtacacggagtactcgataatcttgccggaggtcacagagggtggctcccaggtgaggtgagcaccatccggactctagaagccagggggtcagaaggtcaacagaacaggctagaggcttccagaactgactaatcatggttcccataagccattttctaacacagtagagatattccatgtggtagttcaaggagcttcaaagagatcttcccccaagtggaaggactaagacaaactgggactcaaaacctagctctcctatgcccccccccggccacctcatgtgctgaggcaggcagaaaccaaccagggacagacggccaccccacagcaagactcactttgctgattttaatggcacaaggggcccctgggaaaccaggcaggcacgtcttaaaggctgagatttcgctgaagggcccccggccacaggcattgattccggcaacacgaaacttataggctgtgcctggctgcagctcctgcttcttcagctggttatagtcagggacggtgcccaaatcatcctaggaaaagaggagtggcatgaacgccactgtggagaaggcagctctgggccaccccaggaacactgcaggtccatggtaactatgggccagagggaaaagaggtcagcggtggctggcccctcacggcaaggagggacgtggcgaggctgactgtggcccggtactggcgggaaggaaccaaagctctccttttctactgcttcaggggggatggtctctgcccaccttcctcaggcttcctggctactcagcttggcccaaagatggaggagtttcctgtaagccccgctcagggtggtggagccaagacccacccacctgaggacatcagcacctggggacacttacgtctgatgggacagcatcatctggtggcaggaaatagtgtgtcaccattacattggtgcccttaatgactcccacatcaaaccactggttttccttcttcatgggggctttgctgggtgggggcggcaggtctggcttctgcaagacagaatcggtgcgacgagatcaggccctcagcacctagaggcagtgctgccccccaggccacggactcaggagccccaacacacccgactcaccacacccagggactcgatgccattggccacttcggtcagggtagctgcagcctgcagcttggctgggctggccaccacaaccggctggggggccacaaatgtgttggatggagccaggcctaggaagaaagaaggtgtcagcgggaaagactcgggaaacctggctcccaagtgagaccgagcctcccgtcctgccctcacctccctgggtgcccccaccaccccagcaccaattcgccctcagtcgcttactctcagtggccgttgagggcagcagcgccacagtgctggggaccgtgccggccagctcattgaggcaattgctctcaatggctgggtcgttgagactgtcggcaggggccagggcctcagtggggaggtggtgatgctgctgctgggcctgggcctcctgcagctgctgctgctgcaccagggcagccagctcctgctgtgtcagcacaatgggtatggtggtggcctggccctcctgaccctcggccgacaggtgccccagctccgcctgagtcacggttgctgctgcctcggaggtgtccatgggctcgccggtgcctgctccagggtcgagagaaacactacttactaggaaggctggccagaagcgggcagcccgggcggaggcccccaaagcctgtcctagagaccccgtccacctcctaccgtgctccactgtaggctaagccctggccgaggggccctgcctgtttcccaggcgctaaccccagccagcctgttctacacggcagtctctactacttggcctgcctggggtcccctgtgctcgtcctccccatcacatctggctcatgccaccctcgagggaaatgggctcctcttcccaggctgtctccgcggcctattgctcccccgagcggcccggcttccccagggttgcaccggcactcacccatgacggcctgctgcgcggcctggagcaccgcctggatggccagggcctgggcttcctccgtggctgcggcctgggcagctgcttctgcagcagccgtcactgccagctcctcgggggtgagccccgttaccatgagggtggtggtgccagcttgggcctcggccattagctcttggggaagtgataactggtctacttcggactgtgtgggtgggggtggctggaccaccacagtggccaccaccgcagagccggcagactcctggcccgaagatggctcccctgtgctgctcagatccacggcggccgggagctcaggggtctgggaggctgacaggacctcggcggactcccccatcagggctgtggaagccgactgcagaagctgccgtggcggcagctgctggcgaggacctggcgacacctggagttcctctgggggctgcaggatgtcaacagcagagaagggcatgtcagaagtttctgtgttggctatggtcactgttattttggccgggatggggacttcagtagtcagagcccttggggcagtctcagtcattgatgagatcttctagaaagggagagaagcccctgtcagaggggaggagaggggccagagccaggcagcagggctgagaagcaagccagccctcacctttccttgtgggcctaagttttcattcttgatgggccagctccagcccatgttaaatagggaggggacagtggttctctgaccagcatgaggagaaaggcccttgagacccccggtcaggtttaacccgtcctcagtcaccctggcctggacaaatgggcactcagacccccgccatgtcttatacaggctgcggtgaagtgacacgcgatgagaaccagtcccagaaataaaagcgccccagagatgcgggggacggtgaggctcctgcctcctgccgcagcaggcaccgaggctgcccttttatggtccggaaaagggaccaggagcggccccatgcctggtacaagagcgacatctggcgtctgagtgtggaactgcacgggcgtaggccgggaaggcggggaagaacacggccccctgggctcttaccggcacagaggggcccgggaccggtgtggactgcgtcacggtggtcacagcccgcgtcagtgtggaggacacggttgtcgtgatggcactggagctggtgatgttcacgctgtcgccctgggtgctctccacctctccctgatcgctggcagcaggtggggggtctgtgggggcgacaggcaggcggctgctcagcaggagcccccccggcctgtacttggcttgaccaccacaggcttcctctaccaccaaggggagggccagataaggcaggacaggctcctggagacctctgtctgcttcaggtacagccaggacgccccagctctccccactggtaaattgggtgccaaggagcctgactggtggactctggacggacccccgccatcgttgtcttggcctttcagcctggggggctgggagaccatgaaagccaggctggccaccttcacttaccttggtttgaactcatgttggaagtgacagtggtggccgtgtgagtggtgcccgtctcgtgggtctcacagggggggttggagcacaccctctgtgttgggaaaggagccagcagcgcggtgccagcctggggggtgacgctgggtgccgccgccacctctaggccagactccacggtcctgtgggaagaagtggcgtcgggaagcagggcacccacgctgaccgacatggtggtgccagtggaagtggtctggtgtgtctcacaggggcgaccagcagggggctgctgcccaccctcgggctggcccgtgcccccgtttgaagtagcggtggtggccgtgtgggtggtgcccgtctcgtgggtctcgcatggcgggttggagcacaccctctgggcgctgcctgcattcgaggtagtggcggtgttggtggtgcctgtctcgtgggtctcacatggtgggttggagcagacttgggtcacggtggccgaggggcacagcagtgcctccagggctgtcacagtcactgtggtgctgggcgagccaccctggaggctctcgcacacaggtgccatgcggggctccccagcacccacgctggaacgggtcatggcagcggtgctgaccgcatggctgtggcgccccgcaggaaggtccttaatgcttgggctgctcagcctgactttgctgctcagaggggccaactgcacaaaagcagggctgcggcccccgggctcccgtgccatgctcggcccaaggagtgggccggccgagcacggggccccggtggccatcacagtcatggtggtgctggtcgcgctggtctggcgggtttggcactgggacttagagccctgggctgcctccagcgccccagtggccacactgatccggatcacggcaggggtgccagctgcacaggcccgacgggcatctcgctggtggttggcgccgacgctcgacatggctgtagtggcagtgttggtggtgcccgtctcgtgggtctcgcagggtgggtttgagcagccatgctgcccggccatgttggaggtggcggtggtggcggtgttggtggtgcccgtctcgtgggtctcgcagggcgggttcgaacagactcggaccacgctaccattctgctggcccacagtcgaggtcacaagagaagcagctgcctcctgtctgtcacagacgaactgcacttgggtgggctgggggtgtcccccaaggttagccacaacagtagtggtggccgtgttggtggtgccagtctcgtgggtctcacagggtgggttggagcacaccaaggtgacagtgccaggctgcacatcaccctggcctgagtcggcgatggtaactgtggcggtgggctgttctgtagtcggggaggccagaatggacacagggaggtcatgcacaggctgggcctccaccccactaggtgccgtgatcagagttacctgggtgggctgggacacgggctggggagacacacgaggaggagagttagtgctgcagctggctgtctgcctgtccctcccactgtcctgcactgtcaccacacaggctgggaccactgaccacttctcaacggccctggcagacgtaagacccactcacccctgcccccaagacactgacttgctcagaggccagggaagaggcaccactttgcctcaaaggcaactgggatgaggaagaggctgtgaggacagggcaaggggaaggcaggaggctggctgaagtcaagtcctttgtcagagaatggaaatccccctcaatgctcaaaggccaacaacaaacgtttcaccgttttccttaatatgtatgaacagaacactgcacacacatgcagacgagctgcggcgtcctgtagaacactgcgagaggaagaacccggtgttcaaacaccaggcatggccaaaccatgacagccaaaccacggactatgacacagggaccatgtgacaccagggaaaatgccccaggtgaggaaaggcctgccatggctgcacccggcagcagcgcaacaccaggaaggaaaggcctgtggacggacggcgtgagcctcacgtgcttccacttgtgtggggtccctcgcccacacgtggcctcaggccctgccctacctgcatggtgatggttggggttgtgagcccgcctgccgctgtcagcgtggtctgtgcggccgacacagtgatggcagtggggttgatcacctggcttgagagggtggcaatggtgcccaaggtggtgatgggcgtggccagggaagcactagtgctgtggccccccgccccggcaaggctggtggagacggtgcctgtcactgtgcctagggtcgtgacacctgaaggaaaggaggcaagagttgggccaaggctgctgctgtctccttcccagcagctcctcctgcacaggctggggcactctggagctgcttgcatagaaggctcgggagagaggagctgctgtgccacccagctgtgccatggggattgaaggccagccctgcttcgttataatctaggggtggcaggggacctggcctatgggtacacacctgtggtgcctttcacaaccaacgtggtgacggctggcttgacggcggagacggtgacgggtgtgaccaggcgaacaccccccatgggcacagtgcggaggatggtgcctggctgtcccggggcccccttaagcaccacctggaacaccagaggaaagtgccaccaacgtcaccaccaggctggtagatgccaccgatgctgcccctcccaggcctgtcgggaggacctgcgtggcgtgctggggtggactgcactaggacactgggctgagagacggctgggagtgcctcacctgggtcactccctgctgcccgtggccagtggcaattttggggacagcagtgatgattttcgcaggtgctccagttcctgaagtcatcaccttggtggtgatgatggtgatgggggacttgatgccaggactgctggtcacacctggatgggagagtggggcccaggggagacaggctctgtgagggctgcccctgctgcccctagactataatgaacatccacaagtcacagccatagccctgcccatctcctcactacccttagacacaaaaggcagcaaggagaagatagaaaagggtaaactaaacagaaacacagcacgccttataacccggactccatttcccctccagtgaggacttgcagacactcatatgtcgggggaggcccctacccgtggcgcccgcctgggtgatgatggccgacatggggatggttttgatgatggtggtcgtgccgggcttggtggtactgggggagacgctgctgatgcccaggatggtgggcttggtccccgccccactggcctgcgtggtagtgatgatggtggtgggcttgccatctgctgaggtcaccagcttcaggattgttcccgctggcaggggccctttggtctgaaagggggaagcaggtgcatgagccggcatcactgccaggaagggaagtgtggtctggctactctccgccggcagccttggcggctcagggaatgttctggaggctgtgggcgaggggagtgagcagcagaacttgctgagccatgtgtgctcatgggatcttccatgggcagggacatgagttcttcctgtggcctggcacccaggcccccactcttgcgtatgtgcaaagactgagagctcacctggatgatctgagtcacaggacccgtggacgcctggcctgtgactgctgaagtctgaactggtttggtctggaccaccgacatcactttgcccagattggaaatctaaaaaggaagggatggagcaaggagtgatctggaaaccaaacaagggcatggcctggctgagactctcctggagctggcccagggcggccattcaccactggcagtggccgtagcctggcagcacccatcactcaccagagcactgcctcctgggacagagatggggctcttcaccagggtgatggtcttggtgaccccgcccacaactgtggtcaccacctgggcttgctgggccactgtcacagtgcctgacttgtgcactgtgatgatagggcgggtagacgtgttggtggcggaggaaaccgatgtccccacctgggcggctgcagtcttcagcatgcgagtggcagggttgctcacctggaggaggcagagacgagtgacaggccaggcaaagaaagcgatggggaaaccacccaagatgtccacggtgggcccatagctcctgcctcaacactcaccttcctcctcctcctgctcccaagcccaagaacagcttggttcccccttcctttaacaggcaagggaggaggctgagcctgcagctctcacctgaggccatgacgcccctaatggagacagcttattctgcagcccacggtccaacggctaactctaaagcccggagggaatgactatgcttgtttgaccacagtgacaagccccggaagacgctcaccatgactggcgaggaggccaccttcacagtggctgggagggtggtagtgccaggtgtcacagccatggtcttcacgatggtggtacccgctgggacactcagcaccgtgggtgccgaggaaggggggatcttctgggtggcagcggccgcagcggccagtgcggccatcccactcatctgtgggctactgccaatcacctgcagcaggcacgggcatgtgaggccaggtcacaggtgccacccacctccctgcttggtggacctcaccggaacctgcccaggggctgccctgctcttgggagcctcatcccgccagcatggctcagctttctctactgccagaccccgctctcctggccccagacacagagggctcccaccacccaccatgcacggcaacccccgtggcaagaggcagctgggagctctggatcctttctaaagaccagagtcaggtcccgttgattctcatgggcctgtggcaagcccagctggctagatcctcctctcaggctgcaggacaagaaagtccacgtggcaaatgctcttaggatcaggcagcaggttaggccttctaggcattaacctattaattcccaccatgacctcgcaggagcgtttccccatctgcacgtcccaggagggaaaggtgtggggtgcgtggtaccagagcccgagagggatgtgaacccctcagtacacttgcaacttaatccactggatcaacaggaaatcccacccgccccagtgaccactcctcaccgttccctgggcactctgtgttggcacaaccatccgcactccggcgggaagggaggtcacggtgacaggggctttcccagcctggctggcaggtcgcatggtgaccaatggagttcctgttgtagcctgaggaccggtcactttgagaacagcagggacacctgatgagagaaggggccagccgtcagccatcaccttctgcacgatgtccccagcccctttgcaggcagccctgagccacttctgttggcctgcttgtgtgggagtctggctcttctctgtgccctgagagtgaccatttccacaggtggggccaggctttagcatccccctacaacccttggagacaagcccaaagctcccggctgctggcctgctgtctaggctgccgtctcgcagcccctacttggccgctgcctctccccggaggctagccccctactttcaaacgtccctggtcccctggctcaccttgagtcctggctgcggtgggcacagaaatggagctgccaggcaccgttggcaagacctggatggtggtggtggtcgggggtgcgggggcagcctggggcaggagcgtgatgcctacttgggtcagcggctgcacagcaggtgcggctgctgctggggcagggctcttgggagggttggcaggcacagatgggaccggattgggtgtaggggaggtggcagtagcagccgtggcaggaatgtcatatttctggagctggagaaggtagctgtcggctgttgccactgccccccagctcacctccagggagttggtgttggcgcgtaccagttgtactcgggctgggggtggtggcttttctgtgggagaacgcagttggtgagaaggggcgggaggctatgggaggaggggagtcggctgggccgggcctacctgtctctaggtaccagaggtccttgcagcagacctggttgttccaggccttgcggtagccgtcacgcccactccaaatgtacaggcgggtgttgatggcgactgcgcagtggccagcccgagcacgggggatgttgtcctccagtgtatccatcaggatggtctcccaggccatggtatctgggggagggcagacaagggaggtcagcaaggaggatggaggaaacccgccacccctggttgcccttggttcttttgttgtcaaggatgggaattaaaatcaagaagttattggattattacattaaaaacaacaaaacaaagaaaccctttgtggcaaaaagcaacacaaaaaataaaattacaaaccaccaacggccaactaagaaaaccatgagaaacacagtcagaggtttacctccttgcccgttaaagaacactacaactcacagaaagagacggcaatgggaaagtggtttagggaaaacgtgatagaaagatcttaagaaaaaacacacactctcacgcaaaagaaatctaaacttcaaccatcggcgcctggcatttttattttcaggcccgcagcagctggggctcaaggtgagccggagggggagcttcggccacccatcaggcttggcaaagagtggcctgaccattccgtgagggcaccactggaggcgcctacgtgggcacagcctctgtgcagggcagttcagccgcatcggacagcaaccctacttctaggttttcacccctaggatacacttgcacacgggtggagatggtgcaaggatactcacggagcggcgcctgtacaagttacagcagcacaaccgcaactcgaaggaggctgctgcggggcagggacgtggagtgatctccaagatacggcggatgagaaaggccaggtgtggcactgcgtgcgccaggctgccactgtttgtttttaaagggacctatggctaatgctcagatatgaagagcccctgcagggtggacaggaaaccacccacatggctgcctctgagaagcagaaccggagaaccgggaggagggaaggaggccctgcaccgtagaggcttttgcacttttggatgttgggccatttggatggagagctcattcaaaaaactcagaggcggaacattgcttcagagagctctgcccactggatccttccagtggattccaaagggagccgggggcccagcttgctccccgcacaccccacacagctcttaggctgagaagggccagcctcctgcagcctcccacaggccactcggagcccgaggaggccatacccaggttgagacaagccagcgtgttggtacacttccactccttctcgtgtgtggccactttgacgtcatccatgacgagaggcacccagccaccaaacacgtacattctgggagtgaggagggaagagtgggaaaggattgtagagttggtgccaagctagaggccacctctgctaccccagttctagagctcagtcctctggctctccccaggagagtccccaaggatgcgtgaagcctcctgacgtggccctctcctgcctggtggctcagccctcaggagaactgtgtcacctctaccacataaaagtgccgttcagctcatctaaagctcaccttcatgtccacagtttctaggttccctttaggacctggacatccacaaagacacccaggtgcttgcacagaggacctagaacactctgtacctgatagggcggagcctcacaggcccggggagggtctcagactcagcttgtgtgtggccctctcccccctgaatctgtctttccttggtcccccagggtcgtaatggaaaaacagggctgccaaatgccagcccagccagaaagaggcatcctcaggccttagggtctgacaggacaaaactgagtgagagcccttcgggggaggggccacgccagtctagagaagagagacgcaggtgagcagccacttacttatttccgatggtggttgccgagtggagactgcgaggaagaggcgccaccccgctgagactgggcttattccacgtcagggtgtctgcagagagacggaggggaaagggttacacaaggtagactgcacacaggtcgttccctggattcaagctagctcaggaaggtaggatctgtctcagtgagagaattccatccctggcttccctatagcctacggcaggccctctgactgttgtcatggtagctagattcctgtgttacccaggcggtttcgaccaggctagcaatagcgctccttcaggtacatcctgagcacctgccctgagccaggactgcactctgtgctgggggaggagtggtgggcacaccccgaactctccatgaaatacgttcaccgccataaccaccttaggctacagacattttggcaaactgttggaaaattctctcacgggaaactgcttctttggagtgccgactctgatctataggacaacatcgccatctcctctctcccagctgaagaggcctccggagatccacagttagtaatctttcccagccactcctgataccaccacctggtgaccggcccaagcagtccccgaaggcctcacggtttaccggcatccaatggtaccacagcagtcagaccaggatgcagcactccacacagtctgaccactgacgagtcaagagggactaatgctacccggatccagagaattccattctagaaagccttaatgacttattctcttataagcccgcagaccaattcagcccactcagccagcacagggcagagataacagccccaaacctagggacgatccagggttccccaccctggcccaccatgacaagaggaaagcacgaagtggtatgctccagctccctaagagccccacctcaccatacaacagcgccacccacggggccagccaagaggcagacccgctttgtcccatggctgctggggtgctaccaccctgctcaccaatatctagggtccacaggtcccccagcctgcagccactcatcccgccgtagatcaccagcttggacttcttattgtctttttcggtgtagaccacggcagtatgtgactcccggggtggtggtaggaccccgtaagtgatgggaatgtcccaggctaccactccagagcctggccgtaattccaggatatataagtcattcaggtacctgacgaggaaagatcagttacggcaagtctcgactcctcacgccagaggcttcgctggatggctatcagtgagtggcagcctccccagaacacaaaggggctagggctgtgggagctctgaagttcttctaccctagctcttgaggaaggggctgccagaagctccctaggatgagtccaactggaacaggggacacagggtgggtgaggctgcacagcagccccgagtccagacccagcagcaggcccccgccatgcacacaaagctgggtattatatgagggctccgcagagcaagagggggcgctggcttgggactacctccagacagagagtccttggccacgggccttggaaaatacccatcaggaaacttgtaggcagcggaggctgagaaggaacgcgagcagctctaagccgactccgagagctgggccagcccaaggcaaagtggcttccacctccagcttggccctcctcccacgaggcctgctcagggtcagtagcgattttggagcccgaaagctcctgagagggcatccggtgccgctctctcatttacaacccagcacgagaaagggacccggccacggggctctgctgcgcacattctttaggacaccatggagccctgtgcatgtgagagcacacccacccggggggttccagagaaaaggaccaagcctcaccttggaatgttgttctttgggtcctcgctatcattggccagacccccaaacaggtagcatttgttgcccacaagggagaagctgtgcccgagtcgaggacacggagggggcccgtttttgggcgtctttgctttgagtctcttccactcccaccggctcgcctgcaaaatcaagacctggagactgaaccgtgggatgagaaggccaccactagggacccggggcaacttgtggtggaggaggaaatggccgggggtgagcgaggtgccttgctggagcaagaaggtcctgggtgttggtccttgctgccttcttctgaggtgggccaagttcagagcagccttggcagactctcaagcgtcccttccacctcccgcttgcctcaaccctgaagccactaccgtcaggtcacatggggccaaggaggcagagtgagaacctggggctgctttacctggagttcgtagaggtcattgctgtatttcccatactccaccatcccaccaaacaccaggaggcgagtcccgtcacacacgaagccataggctgcacacccagggggaatgtcccccctcacggctgggatgaaccactggttggttgctggggaacagaaggaggcagaagtcagaacacccgggagcccccattcctctcattccccaaatgtgccagccgtcaagcttggtgagaggggctgagccagcaccatccctgcgggcgctctagcaactccagctgcgctacctgggccatcttccaaacccctcgacttcaggccagtgcaaaagagcctgtgaccaccctgcttctcgccaaggtcatcttaatgagcgggaagttactgtgcaagatccctcatcagctactgggaatctagccactgccttccttccctagcactcagtgatcagacatgaatttctccccaaaataccctcttggtgggcctgtgctcctcctccctggagcccacatttttgtcccttcatcacagggtcaggacagccagagcccagagcagcactttcaagtggccaaaacagtgaccgctgcaggctacgaagagccatggggatgagacccggcctctgctctgacctcccggacttcctctggtctcctaggtgatggtccaccagcatccctccctgcccctgctgccacacctatggtactccagaacattcttgcaagccagaggcagcagtctcagcagagctgtgacagaagcttctcaaaagctcatgagggtgaggcgaccaccaagaaagagggaaatcagaccttaggcactgctttgcttccacaggatggcacagcagccttcagctgggaccaggcccctccctcatgtcctcaaacttgactcccctcacacctggcaggccagggcttccccgaaaacctcctcctatgaggggtccctcagaggattcaccacactctttccagaaaccccaaactgggggccaggtgcaaccccgactctgtgcctctgagctggcctgggtgagatctcagcaagcagacggcagaaggaactgaggcccctccacatgactcaagacgcaagatgggtcccccaggacgtgacagggcatggggggattcctgtggggtgggaaggcttccacacagggatgctgtgatattgtgatataatacagactattcagtttggtggccaaaagtgttgtgagaccatagaagaggaaaaacagtgttttttttccatattcaggtgtgcacccagggccaggcggctgaccatggttgggaatgcatgccccactgcactctggtcccacccagtctcacactgtcacccccagggctcaatgcggaaccgtgtgcaaggctagcccttatccaaagcacaactcccagcctgggtagcacagggagaccccgtctctacaaataattttaaaacactggctcagtgtggtggcatacacttgtggtcctagctactcaggaggctgaggcgggaggactgcctgaccctcagagtttgaggctgcagtgagctgagaccgcaccactgcatcccggcctgggcaacagagcaagacctaacctcaaaacaaacaaacaaacaaaaaaaacagaaaaccccacacagcacaactgtaccaccaccgctcctcctgaggcgagagcacccccaccccgctctccagcacccactctgcgggtaggcttcgagcaggctgacagcctctgcagccattcagctgagtcactgggcctcggacatgccgagcactagagctcccctgccatttccctaaagcagagggacaacacctgtgccgcccgcatgtgcaagctcggatcctggccctctgcctctttctcattcccagtgcaaaaaccaccccagaaaagcaagagctgccaaggccaacagccttgcgcactggagagccgtcctgaccaatccctggagggagctccatgcaagctaccagggtaaacgcataacgagacctaaggctgcctgggccaactgctctcggtaggtaaaggggcagagcccaggagggcaagcgacacctgaggtcacagcgtaaaacagagacagagacaacagccccatcactgacttgaagcaaccgatctgtgccttccctagggtcccatgtccaggcagccaccctcactcccctgagcaccctcgtggtcaaagcccacagctatggggctgcgggtcagagtttgggacaaagctaaatggcacgtggggtcagtgggcagctttcctatcacacgctgatcagtgagccggtgggccaggccagaagcgccctgtgatatctttggggatcccgctcaccagatccttctacaggacccaagaggtgctgatctcattctagaacactccaggcagggcaggggccctccccacccccgtcaagagaggtctgtcagggagcacagctcctggtgtgacgacaaacctgcggctcctcatctcacccacgagtcctggttccgccccctgaaagcacacgagcaagctctcctcccttctcccagcttttcaatgtgacagctgctctcagtcacccctgaatcatctggggggtgtcatgtaacccaatccttgggcccctcatcctggaaatgctggctctcagctgggaggggaaggtggggaaaggaccctgcactagatgaagaccactccagctcccctctcctgagcaaggctgtgccccggcctctctgtgtttcatcagctcccccaaccacttcatgctctgcaagctccatccctggttgccactgtcccatcaccacctagagactggtgcccatgcagtgaggtggccggtcaagttcaacgagctgccttcctctctgttctacctgtcacattagagcatttcctgtgtggcatacgacgtgctgggaggcacagaggacaccgatcttgtgctcatactcccaatggggtaggaaggctgcatgcccccctcccacgatgagacaaacaccctagaagagctctgaccaagccgggcccttgggagcacagagcagtgcgactgctggagaggggaggacaggagtggaaagggcttctcagaagaggtgacgtttcagccgggccttgaagggtgaacaggatttcccgacaaatgaaactagcagggccaatcaggaagtgactgcaagagtctagtaagaggagaggagggcttggtgtggaaggggacacatttgatgcctgcccaacgcaatgaacaattagatacagggacagaggagagaatggaggcatttcaaaggtgatgggccccaaagacaggtggcagaacggcctctatgaaggtttgcactcccgcccaactccgccaccagctgggagggcgaccctggacctgtcacttcccctcttggaccccaatttcctcatctgcagaaacaaggaagtagttccactaggtattttccaaggctccctccagctccaagaacctatggacattacagagccaccgtagccaaagctctcgctcccccaccccccacacctggcagcactctgaatcctttggcttgccacatggaactaaaattccctaaggacaagcacagtagctaccctaagagctctcaaagcacacaccccctgaagctttcttatcctagcaacgggaaccccttccagatcagctctctccaaaggtacaaggctttttgaggactgatcccgcagaactgcaaggggcacaggcgtgagaatatgccctgatctcatcccaaacacaacaaaagaagacaagacaaaggtgacgaggccgggctggcgggagggggcagaaaccccggtgaggaagagggcttcaggtctgccagctgctctctcgtctgaggaattgccgatgacagtttccaaactgctaccctggaggatcccagagcttcattttaagcagccctttggaaggcaggctacccctctaatgcacaacctgtctttgcagactggtaatgaattcatgccaaagtggtcaattcattttaataaactaatgaatatgcagaggccccaggaagccaaggcagcagtggtggtggactctggagccgactgtaattaggcccctgccctactttctaaaattgcatttccctgccagggagcctgctccaggccttatgagaagaaagtcggtccacagagtggagaaggtgctgctcatggtgacggtgcctctataaacagccccaccactggagaagccttagcttactgagctaattcctgctactgcagctgcctgggctggcgcggggcaccaccaaccaccaagcgcccccgcccgggggctgctgagaaaggccctgctccctggaggcaacaggtgctgagagacctggaacgaaaaacggtcacagacaacccaccagcctttcaaagtcaacgtggtaggtggcgataatctccgagatgtggagaaaccagcactttctgccttggggggtggggaaggaagcggcacccaagagcccagctccagccttcccaactccctaaaccaactttctccctccaggcagctccagcttcccacccccagagcatcgaggcactggagctcagccaaagaacagcagcctctcaccgctcaggacacaaagcccactcagcgagggtttgtctgcagggccaccaccgaggccaggggatcgctagagcccccaggagagaacggccgcggagcaaggggttagtgctgggagccgtgcctgccactcaggactagggcatcccaaggccctcccccagccgcctgcagggggcttttccctcacccagactcttccagctcttgcctgggaccgaactcaccctgaccctgccttctgggcaaggccagggtcctgtgggccaacgggcagtcagtaggcaacttgggaactgacccttgtgctaggggcacaaaacgggccaagtagccaccaagaaaaaggatgccacaaagctgtcgtggacagcagcaggctttctgccctagagactaagcaaggctactaggcagaggcaacaacaaacggcccccacgaaggccgtggtgcatcagccatacctgaagagagaggttcctccccttcccaactaacgggctttgggttttgcagggaggcagaagagcgggtggggtaaccccctggatccgcagaagcggggagacacacgactacgcaggccgctgaggggtaactggaattcagcttgtaaaccagaaggcaccagattaggagaaggggcgacttggaaagaaatgctgcagaagtaaacgtggaaagggagaggcggccctgccgccggcccgtcctaggggtccccaaggctccggcattacccgggtcggcggatgttaaactctgcgtcctaagagcgcttcccttccctccctttttcgagagacagagaacgaatctgtaatctagaaatggtcatttctccagaatgggcactcgagatgagggagagctgagcaggcgcaggagaagggagggagggagggaggggagctctgcctgcgccaaggggacacatccgcccgccccagccccagccccagcccgctgggtaacggtgtgggtctgaagtcaccaccgctggcgacagcccctctccctcaccagtcggactaggggctttcttttaactaacgaaaaccaatcctcaaacacgggagagacaagggaacggggagaagatcagagaaaagcactgaagcccggcacagcaaaggggaggggcaagccgatcagtggggagggagggggaggaggggagaagggggagggggacggggagaggggagaaggacgggtaagggaggaggggagagagagagggaagggtagagggtgagggaggagatggagggagggaggagagggagggagcagatggagggagggaggaaagaggagggagagggaggagatggagggagggaaagagccgaagacccagcgggctttgcactcacccgtgttgtacacgtgcagttcgtccactattccctcgttgccgccgccaaacaccacgatgagctccttgatggccacggcgcggtggccgtggcggggccgtggcaccggacccgaccagcccaccactcgcttccagcggggctgcagaagcaccgctggcaagttggcgggcgacacggccgaagccatagttccgggaaagggtgcggtggggagaagtcaacaagcgggaagggagcccctcaattcctttcacacaccccctttcgtctaaggcagctctcacggagaagcggtttctcacacagcggtagacgactccatggaggccgccatcttaactgccctccttccctttggctcttccctttcttctcgctcaccccgtctccgcaagagccgcccgaaactgtcgagcgcctaggctcaagaagctggaggccgctgagtcccgtcgccccgactacttgtccgggcgctcccgcttacaagctcgggcgggaggccctgggagccgccatcttgagccgcctctctctcctcccttcctcagtcgtagccctcccccgccggaaatggcggagccccggcccggttcccacacccccaagtccccagcactggccggcttccggggcgggtggaaaggagccacaagcgccgcggtcgtcgcagccccgccggcgctcagaccacaattgtgggagccgccatcttgagaccgtcccgcttccccgcccagcgccttagtgcagccgccgctcccgaaacagcctcgacacacctaacgaatggaggcgggccggaggccggtggaaccagctcgagctctcgagggccgtttgggggctcgcgccgtacggcttgtgaagtctcgcgcctctccccttagtccgcctctgctgctcaggctgcgcctgccgccgtgggagccgccatcttgagactagctccccgttcccccctattctcttcctcctaggtcagttcttccactgcacaccaaactcaaggcggtgtccgatcctcacttcccgccttatgactccttcccacaggagccgcttcaaagagctagagttaggccccgaagcggcaactgtacggcagaagaagcggtaacggcagggcgctcatgcctcctccctgggagccgccatcttgtgtgaagaagtaacaactaaacatggcggcagcggcgccggcggtcgggcgaggaggcggagccgggtgacgtcaccgcttccccccactcgccctcgcaccgcttcgcccctgggcccaagcctcttaaaggacccctgcgctgcctcgcggcgggggtgggggtcggcgctgccgcgcgctgggctaaagctcgagtcgcgctcagatcaggtgcaggcgcaggcgcgccccgccccacggcccccccaccgggcgagcctccacgcctccgccctgggagccgccatcttgccacttcccctcgcccggccgtccgcgggcgtcaatagcgactttcagcacaaaacaaagatggcggcggcggcatctcggaaatgcccggatgagactgctaacccctccgacgcgctcggccccgcccccttgggaacggtctctcgggttgataagggacgcacgcccgaagaactgcctttaaccagcactggggacagcggcacgcaggtggccggggttggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggtggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgtaagtgctcaccgcagccctgggaggtgggtcccggcctcgcccccacgtttcgcctcctctaggaggccgcccgggcgcggcggcggcggcggcggcggcggcatccgccctgccacgcgcaggccgcagcgcggggacccaagctgctgcccgggagcggcagtcgccagtagaaatggacagaccggtcctgtcagagcctgtggcttttgttgtaaacgtctagaagttcagttaaattacaagatctaccagatctaccggcgggcagaattattactttgaagttactgaagttatgcgtcctgctggaagaccttgtaatttaatgcgttagtaaagaagcacacgtcaccctctcacacattttcaacaatatttttaaagtcgcctctcaacatattacatgtattttgtaatcgtctgtgttttagttcatgcagttggaagtatccatttgagaagggacaaagagaagaattcttgcctgtctgtgccaccacctgctctttgtgaccttggctagttacctcacatatgtccccaagtcccccacccatggtaaataagaaaactaaggcctgatgcgttggctcatgcctgtaatcccaacactttggaaggctgaggtgggaggattgcttgagcctagccggggcaacatagcgagacccggaggcatggtggcacacgcctgtggtcccaggtacttggaacgctgaggtgggaggatggcttgagccagggagttcagggctgcagtgagctgagatcgcgccactgctccagcctgggcgacagagcaagaccctgtctcaaaaacacacacacacacacacacacacacaaaagcagctgctggtttccaagggccttgcctggaatcagtccagaagctaaattaatgttaattgatattcctttatccacagaaagacagcaagaaaggtcatgcggagcgggggacataactaaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaagctggtcatggaagggtggaaagccagggcagacatgatcccatccagggctgctcaaagatgctggggctgcggtgtgcacacccctggacccagaggcttttttgactgggaggacggggcaggaggagttcgggtgccccatgctgagatggcaggcttgtgtgaagcaaggacgtatggagtgatagtgaggactgtggttcctgtgtggcaacaccatgcttcagagggcaatggggcacccacatgccaagcctggtggccctcctcagcaacggaactccaaggcaagaaggctgagaatgaggcccaggaggatgcggtgggccccaggacctgcttgagaagtgaaatagcaaacaggactggtaaaagggagcagaggtgctggctttgttctttaatataattgaattgaaattgagcagggcttcactgggcatctgaggaagagcaaggaatcagaccctgtcccacccatttggggcctaaattgcagtagggcagatggacattgcacctcaaaaataaacagtgcttgtcacatgaatcatttgcaaatattttctcctatattgtctcttcattgttgattgcttctgtgctgtgcaaaagctttttactttaatatactcccatttgtctgtttttgtttttgttgcctgtgattttggggtcttagccataaaatctttcctggagcatttccccattttcttctagtagttttattttatttattttattatttgtatttatttatttatttattttttgagacacagtctcactctgaaacccaggctggagtgcagtggcacaatcttggctcactgcaaccttagcctcctgggatcaagcgattctcctgccacaccctcacaagtagctgggattacaggcgcatgccaccaccctggctaatttttatacttttagtagagatggggtttcaccatgttggacaggctgggctggaactcctgacctcaggtgatctgcccgcctcagcctcccagtgtgctgggattacaggtgtgagccaccacacccagcctttttttttttttttttttttttttttttttaaagacagagtcttgctctgtcgccccaggctggagtgcagtggtgtgatcttggctcactgcaacctcctcctcttgggttcaagcatttctcctgccccagccccctgagtaactgggattacagatgtgcgccaccacgcccggctactttttgtatttttagtagagacggggttgcactgtgttggccaggctggtctagaactcctgaccttaagtgatctgcccgcctcaacctcccagtgtgctgggattacaggtgtgagccaccgcgctggcctcttctagtagctttatagtttcaggtcttacttttaagtctttaatccatgttgagttgattactgtgtgtggtgagagataggggcctagttttcattcttcttcacatacttatccaattttcccagtgccatttattgaagagaccatcctttccccaatgtaggttcttcgtgcctttgtactacttataatagctaagatatggaagcaatctaagtgtccaccagtggattgatatgtaaagaaaatgtggtatagatacatgatggaatattattgagccatttaaaaataaactgttggcgggcgcggtgtttcaagcctgtaatcccagtactttgggaggccaagacggccagatcacctgagatcaggagttcgagaccagcctggccaacatggcgaaaccccatctctaccaaaaatacaagaattagccaggtgtggtggcaggcgcctataatcccagctacttgggaggctgaggcaggagaattgcttgaacctgggagacgcaggctgtggtgagccgagattgtgccactgcactccagcctgggtgacagagcgagaccctgtctcaaaaaaaaccaaaaccaactataaaaaataaaaaaaataaaaaactattggctgggtgcagtaactcacgcctgtaatcccagcactttgggaggccaaggtgagagggtcgcttgagcctaggagtttgagaccagtctgggcaacatagcaagaccctgtctttcaaaaaaaatttaaaaatttgccaggcatggtaacatgcctgtggtcccatttacctgggaggctgaagtgagaggaccacttgagcctgggaggtggaggctgcagtgagctgcaatcacaccactgcactcagcctgggagacagaacgagaccctgtctcaaagaaataaacaaactaataagataaatcttgttatttgtggcaacatggatgagcctagaggacgttatgttaagtgaaataagccaggaacagaaagataaatattgtatgtgttaattcttatgtaaaatatttaaaaaatcaagctcatggaaatagaagcatagtgggtattagaagctggaaagattagagagtagggaaagattcggaggagtcggataacaaatacaaaatgccagcttcatagcatgaatggatcctgctgttctgcactgtagggtgagcactgttaactacaatttcttgtgtattttcaaaagactataagaaaggatttggaatgttcccaacacaaagaaatgataaatgttccaggtgatggatatgctaattaccttgtttgatcattatacattatatacatgtatcaaaatgtcactctatatgctattaaaaataataaaataggctgggcacagtggttcacgcctgtaatcccggcactttgggaggctgagggggacagatcagttgaggtcaggagttcaataccaccccagccgatatggcaaaatcccatctctactaaaatacaaaaattagccgggcgtgatggcccgcctgtacttccagctactcgggaggctgaggcaggagaatcgcttgaacccgggaggcggaggttgcagtgagccgagatcctgccactgtaccccagcctgccccacagagcgagactctgtcccaaaaaataaataaaataggccaggtgtggtggctcacgcctgtcatcccagcactttgggaggccgaggcgggcggatcacttgaggtcaggagttggagaccagcctggccaacatggtgaaaccctgtctctactaaaaaaaatacaaaaaattagctgtgcatggtggcgggcgcctgtaatcccagctactcaggaggctgaggcaggagaatctcttgaaaacgggaggcagaggttgcagtgaggcaagatcacaccactccagcctggacaacagtgcagacagtgcaagattccgtctcaataaaaaaataaaataggccaggcacggtggctcatgcctgtaatcccagcactttgggaggccgaagcaggtagatcacgaggtcaggagttgaagaccagcctgaccaagatggtgaaaccccgtctctactaaaaatacaaaaattagccgggctaattttagttgtaatcccagctactcaggaggctgaggcaggagaatcactcaaaccccggagggagaggttgtactgagccgagaccacgccactgcactccagcctgggcgacagagcaagagtctgtctcaaaaaaacaaaataaaatgaagtaataataaaatagtgctaagtggtctgcatatacagatactttttttttttttgagacggagtctcattctgtcgcccaggctggagtgcagtggcacgatcttggctcactgcaacctccgcctcccaggtttgagcgattctcctgcctcagcctcccaagtagctggaactacaggcatgagccatcacgcctggctaatttttgtattttagtagagatggggtttcaccatattggccagggtggtcttgaactcttgacctcaactgatccacccacctcagccacccagagtgctgggattacagacgtgagccaccacgcctggccactttttttttttttttttttttttttgggggggagagggagtttcgctcttgttgcccaggctggagtgcagtggcgtgatctcggctcactgcaacctccgcctcccgggctcaagcgattctcctgcctcagcctcccgagtagctgggattataggcatgtgccaccacacctggctaattttttgttttgttttgttttgttttgttttgttttgttttgttttgtttttctgagatgaagtctcactctgccgcccaggctggagtgcaatggcacgatcttggctcactgcaacctctgcctcctgggttcaagcaattctcccgtctcagcctcccaagtagctgggattacaggcgtgcgccaccacgcctggttaatttttttgtatttttgtagagacagggtttcaccatgttggccagactggtctggaactcctgacctcaagtgatccacccgcctctgcctcccaaagtgttgggattataggcgtgagccaccgtgcccggcctaatttttttgtatttttggtagagacggggtttcaccacattggctaggctggtctcaaactcctgacctcagatgatccacctgcctcggcctcccaaagtgctaggattataggtgtgagccactgcgcctagcttttttttttttagagatagggtcttgctctgtggcccatagctcactgcagcctccatctcctgggctcaagtgatcttcctgcctcagcctcctgaggagctgggactataggtgcaccaccatgcctggctaatttttattttattttttaaatttaattttatgtattttgtgtagagacagggtctcactttgttgcccaggctggtctcaaactcctggactcaagcagtcctctcaccttggccttccaaattgctgggattacagatgtgagccaccatgcccagctacatatgctttttgatgtataacagggtaatgtccagataaacccatcataagtcgaaaatataggaactggactttcaacttaagaggggtttagctgggtgcagtggctcactcctgtaatctcaggactttgggaggccaaggcaggaggatcacttgaggccaagagttcgagaccaggctgggcaacatggtgagaccctgtctctacaatttttttttttttttttttttagatggagtcgcgctctgtcgcccaggttggagtgcagtggcgcgatctcagctcactgcaagctccgcctccagggttcacgccattctcctgcctcagcctcccgagtagctgggacaacaggcgcccaccaccacgcctggctattttttgtattgttttagtagagacggggtttcaccgtgttagccaggatgctctcgatctcctgacctcgtgatccacccgccttggcctcccaaagtgctgggattacaggcatgagccaccatgcctggcccaaaatttttttaacaaaaattagcagggcaggccgggcgctgtggtagggaggctgaggtaggagaatggcgtgaacccgggagatggagcttgcagtgagccaagatcgcaccactgcactccagcctgggcaacagagcaagactccgtctcaaaaaaaaaaaaaaaaattagcagggcaaggtggtggtatatccctggtcccaactacttgggaggctgaggcaggaggatagcttgggcccaggaggtggaggctgcagtgagctgtgattgtgccactgcaccccagcctgggcaacagagcaagacccccgtgtctaaataaaaatacccaggccatggcagcagaaagcaaggaagaagccacgtggaagccctcctggcgcttcttccagggaggtgagcagagagcacctggggccaggaggcggcatgcctgggtttctgctcctcctcactgtaactttcagccaagtcaaactgctagagtttcagtttctttatctgtgaaatgccggggctggcacagatggtttctaagatccctcccaggcctggaacttctaagcgattaggtcaaaggtgagctaaccgggctgggcacagtggctcatacctgtgaatcccagcactttgggaggctgaggcgggtggatcacttgaggtcaggagttcaagaccagcctggccaacgtggtgaaaccccaactctactaaaaatagaaaagttagccgggcatggtggtacacgcctctaatcaccgctactagggaggctgaggcaggagaatcacctgaacctgggaggcggaggttgcagtgagccaagattgtgccactgcactctagcctgggcaacagagtgagactccgtctcaaaaaaaaaaaaaaaggtgcacaaaccgaggcccaagacagttaaggtgcaagatcacatggttagtaagtgggagagccaaggtttgaacagtctggcatcagctgaccaggaactggagcccacccttctctctccctgagcccgcctacccgcccaccctcttgagtgcgaaatttattaatatggaagggagaagagctttaatgattggagtcattttcagagcattaaagctcttctcccttccatattaatgtatttctcagctactagggctcacttacagcaccagtggccccaaagcagttgacagtcagtggtaattaaattgtctctctggttctgtgactgaaggagacagaaggctttatggtggcctgaggaaagaaggtgatttggggcttggcacttcaggagagggcaggcgagtgagccagggaagctggcctgggaagcctgcgggtcacccccttgcctcccggcctggtgcttgagtggcagacggtgaatcctcctcctcctccatcccccaccttgtgtcagaggccagagctcggactccatctaatggtctctagttcagctgggtatttggtgaaaagggctttggggctggagacgtccacttttataacacactgacatgggaaggcgcattctgagttgtaatgacagagctagacaggtcttgtctgtagatgcagtggctttaaggaaactaggacgatgggcaggattttcctaggtgccaggagaaaggggtgatagaggattctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagagcgatcgtctggagtatctttggggtgtcagctctgggtgtggactggcagcagtgaggcaggccagtcagtggggtaccagtgagtgtccttagaggcggctggattcagggagactgagtcacactaaatacgtgcccagcagactgatggggaaatcactcaattatccccatgacatctgtgactgttaactgtaggcaggtcacgtgagagccacatcacctcagatcgtctgtggaaccaggcagtgtgcatccagatgaggaaacacacaaatgtcaaaagttgaactctcaacagaaagttgctttgtgggtctcccctcagagccagggtgtggcttagatgcccttagtggctacagtctgagcagtccccacctgcccgtcacccaggtccttgcgaaccagtctgctgacagtatcgtcaggcactgtgctggaggcggcacgtgcttctcatgcaggcaacagtttttgagccctcgagcccaaggcccagactctctagtttgtggtcaggatgctgggtcattcttagccgcagccagagaggcactgaggactccgtgccaccctctctactcccgggacagtccttcctgccggtcactatgttacttagaggcctgcctcacctcctttcatctgaaggcatctggtctgtaaaggggacttccttttttcgagacagagtcttgctctgttgcccaggctggagtgcaatggtgtgatcttggctcactgcaacctctgcctcccgggttcaagcgattctcctgcctcagctgcctgagtagctgggattacaggcacccaccaccacgcccggctaatttttgtatttttagtagagacggggtttcatcatgttggccaggctagtctctaactcctgacctcaggtgatccgcccgcttcggcctcccagtgctgggattacaggcatgagctcccgcgcccggcctgtaaaggggactcctgaagacaggtaatgtcatttaactcaggggctcttcatcccagactccatagtcttgtccctggagccttaagtactaaggagggtctgctttaagcccacaaattaaatggagaagtgaccagctccaaaggtgagggcagaggagagaggatgccctgtccctgccaaatggcatctcagcatgggccacccatgtgcacctgctcagtgccctcgaggttggcattcggcccacgactgtgatgactgagatgtttctggaactgggcacctgggctggatgttctgtcctggctggctgagcacattgccaccaggtaaggacctggggcaaatggcaggacccgacccagggcttggggcctgggggtggggcacgtggttggcaggggagagcaaggacagcacctgcttgggaaacagcctggttccatttgaggtcgtctcgaaagcaccatgtgccctagaagagggaagaggctgcacacatcaccagagaggccacccttacttcacagaggctggagggagggcgaaaagaaggcgggcttccatgcgggctcagagacagggtgggggcaggctcttcatccagcagtgggggatccccttttgtgatttctctgtgagtagctgtttccctcattgacagaggactgctgggacttcatgccacacctcgcagcaacaagcactcatcacgattttactttttcttcctaccaatacctgtgtaataaacagccctgcgagcctcctgggtcaggcggggtcccacgggaaacaggtggtgtgcctagattggggtgattcagggcggttttgtgggacacctggaagagtggaccccacccaaaggagaggcttatgtggaggggacacctccagaggggcagggactgcaggaagcctggctccgctccctccctctcctgccagagttgccagattatacgccaggcgatgaacaatggttttgcacaagcgtgtctcaaatgttgcatgagacatttctcctactaaaaaagtattgtttacctgaaattcagatttcactgggtgttctgattgttatttgctaaatccaacaaccacgtcctgagccaacacaagcagagccagaagccccggaacctgcgcaaggcagagcaggtggcaaagaaggctccaggcaggccccggcctggaacctgcactccccaggccctttttgaaattagtgtttctccaagtatggccagttgccattagtcacacagcttcctgcatcccttcctgcccaggcgaaccccccttctggggccgggacctcagagtgcctcagccctggcccggggtttgcggattccaccaacccctgagccactggaggaaggaggctggcggctgtgcctccctccagctctgcagtccacggaggagctcggcctcgcccagggggattggctgtcagggccgccgttgccgttactggtcttggtctcagtctcgctgctccactgcgtccccagcacagctggggagccaatggttgccagatggggcctctccccgacctttgacctaacggtttagaggttccaggcctgggagggatcttagaaaccatctgtgccagccccggcatttcacagataaagaaactgaaactctagcagtttgacttggctgaaagttacagtgaggaggagcagaaacccaggcatgccgcctcctggccccaggtgctctctgctcacctccctggaagaagcgccaggagggcttccacgtggcttcttccttgctttctgctgccatggcctgggtattttctccccacataaaatagttttagggcctggcgctctggctcacgcctgtaatcccagcactttgggaggccaaggcgggtggattatctgaggtcaggagtccgagagcagcctggccaatatagtgaaaccctgtctctactaaaaatacaaaaaattaaccaggcatggtggtgggtgcctataatcccagctactcgggaggctgaggcaggagaatcgcttgaacctgggaggcagaggttgcagtgagccgagatcacgccactgcactccagcctgggcaacaagagcgaaactctgtctcaaaaacaaacaaacacacacacacacaaaaatagttttaagcccggtgcagtggctcacgcctgtaatcccagcactttgggaggctgaggcgggtggatcacctgaagtcatgagttcaagaccagcctggcgaacatgacaaaaccccatctctactaaaaatacaaaaattagctgggcatggtggtgggagcctgtaatcccagctacttgggaggctgaggcaggagaatcgcttaaatccgggaggtggaggttgcagtgagctgagatcgtgccattgcaccccagcctgggcaacagagtgagactccatctcaaaaacaacaacaaaaatagttttaggccaggcgcagtggctgatgcctgcaatcccagcactttgggaggctgagaaggaagaattgcttgacctcaggagtttaagaccaccctggacaacgtagggagaccccatctctaccaaaaataaaaaaaattagctgggcttgatggtgtgtatttgtagtctcagctactcaggaggctgaggtggggaggatcacttgaacccaggagatccaggctgcagtgacacagttgtaataagatggcatcactgcactccagcctgggtgacagagcaagaccccatctcaaaaaaacaaaaaaattacagcatagggcacacactatcatgcattcgcttttctgggccccattttggcttggtgacgtgccaaggtctgctagaaactgcacacactggcccggagcaggcccttctccagttaggtctcaggagtgggattgtagggctgaagggaacttcagtttcaaatccctggagtgcttttcccagtgacgttcttgattcacatctctagcagcaatgtgagaggcttctccgccccccaccagcaaatgtcagggtgggtgcattttcatggtgtgccaatctgatgagggtgacatgagatttcattgtgactaactcagaccccttcccctctctcaccgaccccccgccaaaagtagtgtgtgtgcatttttgagacagggtctccctgtgtcccccaggctggagtgcagtggcgcaatcatggttcactgcagccttcaactcccaggctcaagagatcgtcccacctcagcctcccaagtaactgggactatgggcgcaggccaccatccctggctaattcttttgttttgtttttgtttttgtttttttgagatggagttttgctcttgttgcccaggctggagcgcaatggcgcaatcttggctcactgcaacctctgcctcctgggttcaagcgattctcctgtgtcagcctcccgagtagctgggataacaggcatgcgccaccatgtctgactaatttctgtatttgtagcagatacggggtttctccatgttggtcaggctggtcttaaactcccgacctcaggtgatctcacctcggcctcctaaagtgctgggattacaggtgtgagccactgcacccagcctccctggctaattcttaaaaaaaaaaaaaaaaaaaagaaaatttttttttaaaattactatgaaatgtattatttgttattaagttacaaattttttttttttttttttgagacggagtctcgctctgtcgcccaggctggagtgcaatggcgcgatcttggctcactgcaacttccgcctcccaggttcaagcaattctcctgcctcagcttcccaagtagctgggattacagctaaaattagcccggctaatttttttgtatttttagtagagatggggtttcaccatgctggccaggctggtctcgaactgacctcatgatccacccgcctcggcctcccaaagtgctgggattataggcatgagccaccgcgcctggccagagcccagcctaattcttacattttttttctagagatggggtctctctgtgttgcccaggaccacactcctgccttgccctcaaagtgctgggatgacaggcataagccactgtacccaacctcctcattttgtcctcggactcctgggctaaagcaatcctcccaccttggcatcccaaagtgttgggattacaggtgtgaaccactacacccagcctattgtttgtcttctgaagatttatgtggtcatgcatgtctgtctttttcttcgtagctttcggggttggtcttccttaaagcagttttctgagtgtctaggtaacacttgtctgtacctcagctaactttgttaaatctcagcatcgcctgtagctgcttcagatgtttttattataacattttcattataaaattattagatagttaaaaattatgtttataaagaaaacaatgcggctgtcacattgctgacatgacggtttacgtaactatagtgaagtagtgcacttggtgagggagggaaatgccagcacgcttgggcaaggtgcctcattgcagcctgggagaacgaaggtgggtgaggcatttccctcccacgccgaaggcctccgggaatagaaataccgggtaaatatccactggccagttcgtatcctccagtgggtcatcatgtgattggggagcgcttcttcccattcaaaggggatctttggggacccgggtttatggaaccctctctgcgttggtcctgggggctgcttctctgttcagtgaccctgtgactggagggcactgccttggcccggcgcgtggccatcttgttcctagggtcactggagcctgattgctgtggtggcacgccaggtccttcaaagctttcatgtttttattttattattatttcttttctttctttctttctttctttctttctttttttttttttttgagactgagtctcactctgtcgcccaggctggagtgcaatggcgcagtctcagctcactgcaacctccgcctcccatgttcaagcgattctcctgcctcagcctcctgagtagctgggatgacaggcatgagccaccacgcctgccctattttattattattttaaattttattttagtttcgggggtacatgtgcaggttggttccatagacaaattgcatgttgtgtgggttttgtgtacagattatttcatcacccaggtattaaatagtaagcctcatacccaataggtgatttgtttctgtttttctagcctttccttccattgccggcctttcactttgatctttgctgtctgtttctctttggaaccgctgacttctggttttgctcttgcctcttctcggccccacttgacctccactggggcctgggctagcttgtgtgtgccgccaccatctcggccagctcaggtctgtttctttggaagattctgtgcccctcccatgcctctcctgcatgtggcccatgcacagtagtgtgtggctgccctcgcccttgtgtgtgggttttttgttgtgttgttgttgttttgttttgttttgttttgtttttgagatggagtcttgctctgtcacccaggctggagtgcagcggcacaatctcggctcaccgcaacctcctcctcccaggttcaagtgattctcctgcctctgcctcctgagtagctgggattacaggcgtgcaccaccatgcccggctaatttttgtatccttagtagagatgaggtttcagcatgttggccaggctcgtctcgaacccctgaactcagctgacccacccacctcggcctaccacagtgctgggattacaggcctgaggccctgctcccagcctccttgtgtttctctacgtgcacattgtgcagagcctccccacccggctggacgtgaccgatggcacacgtccccagtctcacgctcctgtgcacgcctcttggtgcctatgtgtgagagcttcgcatttcaactcgagtagaatttgccaaatcccttgccagattgggggcagagctcctcaacagcacttgatgtggtcaccggggtgatctgctgatctgacaggagtgagtgacagtttcattttgtccttgtttgcctttttcagcttaaaatcgaggttgcctcaaaacattaaacatagaattcccatagggtccagcagttccactgctgggtataggcacaaaggagttgaaagcaggagcttgaagggatgcaattcacagcacccaagaggtgagagctggccaagtgtccatggatgaatacatagataaacacaatctgctttatccacacaatggaatattattcagccatgaaaaggaagggaatccttacgcaggctaccacatggatgaacctggaggacatcataattagtgaaagaagccaggacagaaagtacctgattccacttttgggagggacctggtgtcgtcagactcagagacacaccacaggatgatggtcgccagggtggggagagtggtggggagttagtcttttttttttttttagacggagtctcgctctgtcgcccaggctggagtgcagtggtgcaatctcggctcaccgcaacttccacctcccgggttcacaccattctcctgcctcagcctcccgagtagtgggactacaggcgcccaccaccacgcccagctaattttttttgtatttttagtacaggtggggttcaccatgttagccaggatggtctggatctcctgacctcgtgaaccacccgcctcggcctcccaaagtgccaggatgacaggtgtgagccaccgcgcctaacctggagttagtcttttttttctttctttctttttctctttctttctttccttccttcttttgtcctttcctttctttcttctttctcttctttcttctttcttctttttctttccttccttccttcttttctttctttctttctttcctttctttcttctttctttgcttccttccttttcttttctttctttcttttcttccttcttttcttctttctttgtttttttctttctcttctttctttccctttcttctttctttccttcctttcttctttctttccttccttcttttccttctttcttttctttccttccttcctttccttctttcttttctttctttcctttcttttcttctttctttcttctttctttctttgcttccttccttcttttcttttctttctttctttcttctttctttcctttcttttcttctttctttctttctttcttctttttttctttctttctttctttttttttttcagagactcactctgtcacccaggctggagtgcaatggttagtgcgatctcagctcagtgcaacctctgcctccccggttcaagcgattctcctgcctcagcctccagagtaactgggactacaggtatgcaccactgtgcccagctaattttttatattttattttattttattttattttatttattttattttattttattttatttttgagatggagttttgctcttgtcgcccaggctggagtgcaatgcacgctattggctcactgcaacctccacctcccaggttcaggtgattctcctgcctccgcctcccgattagctgggactacaggcctgcaccaccatgcccggctaattttgtatttttagcagagacagggtttcaccacgttggccaggctggtctcaaactactgacgtcaagtgatccacccccactcggcctcccaaagtgttgagattacaggcgtgagccaccgcgcctggcctctacttatttatttcttgtagagatggagtctcaccatgttgcccaggctggtcttgaacccctgggctccagtgatcctcctgcctcagcctccccaattgctgggatggcacacatgagccacggggcccagcctcctcattttgtccttaatatctgcttgtaaccacctcaactcagaatacctaccaaaacttagtttggatgtgtttcccaggttgcaatcctcaaatttggcccaaatacactctccttgtattaattttacctcagtgtgttcctttaggtcgacctcataaaatctggtatgggtaattctgcagagccactccctcaccaccgctgtctcgggccatgctggctagcagcgatcgagggcttactgtggacgaaagtcagtttagagaagttgaatggccaagttcacagcagtaggaagtggctgcggtgggctttgccctggggctttggactttgcctggagctgctcctcactcattccaggaagctcttgcaccatgaccgctgtgacttgggatccaaatttcaattgaaaatatatttttttcaatttttttcatttttaaaatttttttagaaactgagtctggctctgtcacccaggctggagtgcagtggtaggatcacagctcactgcagcctcaacctcctgggcttaagtgatcctcccatcccagcctcctgggtagctaggagtataggtgctcaccatcatgctcagctaatttttcttcttttttctttcctttttctttctttctttttttttttttttttttgtagaggcagggtcttgctatgttgtccagttgtcctgggctcaagccatcctcccacctcagcctcccgagttgccaagattacaggccactgtgcctggcccgatgttttttattggggtaaaatacataataacataaaatgtaccatgttaaccagttttgtggttagttagttcagtggtgttacctacattcgtaatatggtgcaaccaacatcatcgtccatctccggaactcttttcatccttctaaactgaaactctatccccattaaatgctaactccccagtccccctcctgcagcccctggaaaccacccttcaggtgtgccacaggtcaaatgtggacacagggaggccactgcacccggccctcagcatctgaacttccacccctgctgcttgaagctctccatctcgccgtccagacaggctgccttccccgctggctctgtataggatgcaaccccaacaggtggagaagctcagcccgcagcacccacacggagccgagatgtgcaggttgccgagccggccccgctgggggggcttctgctgggacagacataacaaacagcagatgtagccccctgccgaggacttcagattgggaattgtcagagattccggagattgtcagattggatggaaacccccacttccagcatatgctgtttactagagacacacctcaaacatatgtccatggaaatattacatgtgaaagaatgaatgctaggcagttactaccaaaagcaagctgccatggctatattaacatcagacaaaataggctttgggacaaaacaaaaacagtttaggaatgatgttaaaataggctctacatatcttaagcaaaagttgacagaactctagggagaaataggcacatgaagcatcgtagagggaggtttcttttttttttcttttttttttttttttttttgagacagagtctggctctgtcgcccagactggagtgcagtggcacaatctgggctcactgcaagctccgcctcacgggtttgagggattctcctgcctcagcctcccaagtagctgggactataggcgcccgccaccacgcccggctaattttttgtatttttagtagagacggggtttcaccgcgttagccaggatggtctcgatctcctgaccttgtgatccgcccgcctcggcctcccaaagtgctgggattagaggcgtgagccaccgtgcccggcttgcagttttcttttttaaaatgtttatttctattttgtgattcaaactgaggatcatcttgctgcaaagaagtttttaagttgataagaaactgctgaacagtgattcaaagtggctgtgccatttcacactcctgctggccgcgtgcgaacctttcatgcactccgcctcctcaccagtgctccctgcgaccagtcttcagtgacagtcattctgggtgcgattttatcttgcatttccccatgagaaatgggcatctcttcctatgcctcagtggggagaaccagagacgggggcagaagaggggcaggagaaggcagggagggtggttggaggagagagcattgggtgggggtggcaagtgctggaggagggggacggggaagtgggccctttgctcttgaaccattttaaccccaagcaaggtgcattcagggtttgggcaggggtctggccctcatgtcaccagatcctgagtgactgtaggggcctctcatcatgtcttcactcctggacttgctggctccaggtgagaagacgtggacactgctgtgggctgcagaggtttgggggtgtgtgtgtgtgtgtgtgtgtgtgcatgtgtgtgtgtgtgtgtgtgtgtgcgtgtgtgcgtgtgtgcatgtgtgcgtgtgtgtgtgtgtgcatgtgtgtgtgtgtgcatgtgtgtgtgtgtgcatgtgtgtgtgtgtgcatgtgtgcatgtgtgcgtgtgtgtgtgtgtgtgtgcatgtgtgtgtgtgtgtgtgtgtgtgtttgagacagggtctcaccctttctcccaggctggaatgcagtggcgcgatctcggctcactgcaccacggacctccgggctcaggtgatcctcccacttcaaccccctgaataactgggactacaggcgcacggccccatgcccagctaattatgtaattatgtcacttttcatagagacggggtctccccatgttgcccaggctggtcaggaactcctgggctcaagcgatccacccgtctcaacctcccaaagtactaggattccaggcctaagccactgtgcctggccttcagggttttaaggaacagtttcatttccacagtggggcggcttgagaagtaggggcaccccaccagcagctgagcagagaagaaatggtggctatcagacagcccaggcctagtgaatcctccagtgaattattcctggcctttaagagacaggtaattccagcgaggcgcagtggctcacgcctgtcatccaagcacttcaggaggccgaggtggacggatcacgagatcaggagatcgagaccatcctggctaacgcggtgaaaccccgtgtctactaaaaacacaaaacattagccgggcgcggtggcgggcgcctgtagtcccagctactggggaggctgaggcaggagaatggagtgaacccgggaggcggagcttgcagtgagccgagatggcgccactgcactccagcctgggcgacagagcgagactccgtctcaaaaaaaaaaaagaggtaattccagggtttcaaagaaagtaaagtttccagatgtgctttatgaagccagaataacctttgtcccccaggagaatgttagtgtcacaaagacagactcttgtgggtcctgcttgcttctccgctctgagtccacagcggtgtctggcacacagtaggtactcctgggtgactcactgaatctggttgcagacttgacacacacacacatgcacacacggaaaagtatcgatactgctgttaaacactggtaggcatttctaaaataaaaacattagctaatatcatccaaaagcagatcaaggcatgaatatccaggctgggcgcggtggctcatgcctgtaatcccagcactgtgggaggctgaggtgggaggattgcttgagcccaggagtttgaggccagcctaggtaacatggtgagtctgtctctaaaaaaaaatacaaaagttaggtggggatggtggtgcgagcctgtggtcctagctactcggaggctgagggagaattgcttgggcctaggagtctgaggctgcggtgagccatgatcacaccactgcactccagcctgggtgacagagggagacctgtgtgaaaggaaaataaatcttggggcccccaaatcactcagctaaagggaaaactcaagctgggaactgcttagggccaacctgcctcccactctattcaaggccactcctctgttcactgagataaatgcttattggattgcttcctttggagaggctcatgagaaactcaaaacaacacaatcattggtctcttatctacccatgacctggaagccccctccccacttcaagttgtccctttctggaccaagccaatgttcatcttacatatgttgactgatgtctcatgtctccctaaaatgtataaaaccaagctgtgctctgaccacctcgggcacatgtcgtcaggaccatcctcaaccttggcaaaacaaactttctaaattcactgagacctctctcagatattcagggttcacacctgactcttaaaaaaagcaaagaagtgaataaactataaccaaatgtacacaacatattgttattaaccatagtcacgatgatgtacaacaaatctcttgaactaattggaattcctcctaattggaattttgaatcccttggccaacatctcctcatccttccctccccacccaccaccctgcagcccctttatgagttcagcttttttattttctacatatcagtgaggttgtgtggtatttgtctttttgtacctggcttatttcatttaacatagtgttccccagtttcacctattttgttgcaaatgacaggatttccttctcttttatggctgaatgggattccgttgtgtacagatatcacactttctttatccattcacccattgataaactcttaggttgattccatctcttacctgttgtgaatagtgctgcaatgaacacgggagtgcaggtatctctttgacatggtgatttcaaatttaaatatatacctttaaatatataccaagtagtgaaattgctggctaatacggtagttgtgtttgtagtttttggactatactgttctccgtactgtctgtgctactttacattcacaccaacagcgtacgaggttcccatttccctgcatccttgtcagcatttgttatttttttaaacatctttttgttaaaagccattttaactggggtgagatgatatctcgtggtgcttttgacttgtgtttccctgatggtgagtgatgtggagcattttttcatagacctgttggccatgtctattcagatcttttgcccactaaaattttctttttttgagacaggacctcactctgtcacccaggctagagtgcggtggcatgaccacagctcatgcagcctcatcctcctgggcccagtcaaccctcccacgtcagcttcctaagtagaaaaaggccagctgtggtggctcacccctgtaatcccagcactttgggaggccgaggcaggtggatcacctgaggtcaggagttcgagaccagcctgaccaacatggtgaaaccctgtctgtagtaaaactgcaaaaattatccgggcgtggtagtgggcacccgtaatcccagctacctgaggctgaggcaggggaatcacttgagcccacggcacgtggatcacctgaggtcaagagtttgagaccagcctggccaacatggtgaaaccccatctctactaaaaacgcaaaaaatgagccaggtgtggtggcgggcccctgtaatcccagctgtctgggaggctgaggcaggagaatcgcttgaacctgggaggcggaggttgccgtaagccaagatggttccactgcactccagcctgggccgcaagagtgaaactccatctcaaaaaaaaaaaaaaaaagtgaaatctgcagagatgacagcttcatgagctgattgtatgaagccacaaacagtactgtgcttaatggtgaaacaccacagcattttcattagtcaagaatgagacaatattcccaggatcaccactgtttcttcccgtttcccaatgttaaattggccaatgcaattgaaaaagttagccggacgtggcgcacaaggaatacgtgttggaaggatgaagcaaagttctcattctttgtaaatcacttgattgcaccactgaaacgtcctctggtctgctgggcaggtttgagtcaggagattctggctgtcttcactgggcctatctgagactgggtgtcatttgctttgctcttgtctgattttactgtcagacatcactcctgtaaccagtctttgtagtaagtctcatttcttgcatgtacttggaagtacatgcaataaatggttttattttcccagcgactgtgcccgcccccaccccattgagttgtgccaaatcccccttaagacgtggggcccgagtccatcatgtttcagtcaggttgcttgtaattagtcttattctggttcttttttcttttcttttctttttctttttttttagacagagtctcgctctgttgccaggctggagtgcagtggcacaaactcggctcactgcaacctctgcctcccgggttcaagtgattctcctgcctcagcctcccaaatagctgggactacaggcttgcaccaccacacccagctaatttttgtatttttagtagagacggggtttcaccatgttggccaggatggtcttgatctcttgaccttgtgatctgcccgcttcagccttccaaagtgttgggattacaggcatgagccaacacgcccggcctggttgtcttttcttttctttctttttttttttttttttttttttttaagacagggtctcactctgtcacccaggctggagtgcactgatgagatctagactcactgcagcctcaacttcctgggcttaagcgatcctcccacctcagcctcccgagaagctgggactacaggcgtgcaccaccacgcctggctaatttttgtatttttagtagagacagggtttcttcatgttggccaggttggtctcaaactcctgacctcagctgatccacctgcctcggcctcccaaagtgctgggattacaggcatgagccacgactcccggcctacccttaattttttttttttgaagtgcacaagctaattttttaattactatttgtagagattaggtctccctgtgttgcccaggttggtcttgaactcctgagctcacgcaatccatctaccttggcctcccacaatgctggactgcaggtgtgcaccacgctctggcatcattctggttcttaaacccaagggtacttattttccaacatgaaccttaacctcacccttccagaaacttctcaggcatgggcaaggttgcagtctcccttactgcaggcagcaatgactttagcaacaggtgatcttggtgggctcgtaggggagtgggaatgggcagtggcttttgtcctccttttgttgtccgctggggatcttggttgggaagcctgaacccagcattgtttcctagccctgtgttcaacaatgccgggagcgaggtgccttcctatccccgtgataaacagttctgggacctgttgctctgccacacaatcctgagaactagcacaagtcaattcgcttgcaggaccaacacacccatgctcctgaaagatgagactcgcagagcccggcccgagactgcacccagccgtccaaggctgaccatgcttcccacccggccctccccacgccggctcggacttcgggcattttctctcctcctttcctccctggtgatctgaggccggctctgtcgggggagtgttcttcctctttgcagtgagtccaataaactcagctttgcctgaacaacaggtttttctggtggtgattttggggagtctacagccaacagctgaaattgggaaaacggggcgggggtggggaatccctttttgttttttgtttttattttttacagtaaagtgaaagcaagtttattaggaagatagaggaataaaagaatggctgctccatagacagggcagctgggaatcccttttagcacctggtggctgcagatgggtagaaatacagaccatatttggttcttagtttaattagccagagacgcagaacagggtgggaagccagacggccacacctagcacctcatcaggctgcagccaaccagggcctctcggggctgggaaaactcgattcttgctgtacttgggcttactcggctctccatcttatgcaaacacctctccttatgaaaggcaagaagaatttgttctacactggggatgggttgtgcctgtcacatggagcagcctggggacctagagggaccctttagaagcttagcacctagcaattccttttcacatgtgactcatggtctattcagttttagtacttcttttttttttgacagagttttgctctgtcacccaggctggagtgcaatggcgcgatctctgctcaccgcaacctctgcctcccaggttcaagtgattctcctgcctcagcctcccaagtagctgggattacgggcacgcgccaccacgcctggctaatgttgtatttttagtagagacggggtttctccacgttggtcaggctggtcttgaactcccaacctcaggtagtccccctgcctcggcctctcaaagtgctgggattaaaggcgtgagccaccacgcccggcttttttttttttttttttgagatggagtcttgctctgtcgcccaggctggagtgcagtggcaccatctcagctccctgcaacctccgcctcttgggttcaagcaattctctgcttcaccctcccacgtagctgggattacaggtgcccaccaccatgcccggctaatttttggatttttagtagtgacggggtttcaccatcttggccaggctggtcttgaactcctgacctcgtgatccatggcgcctggcctactacttctttattcatttattttttgagacggagtctcgctctgtcacccatgctggagtgcagtggcacgatctcggctcattgcaacctccacctcccgggttcagcttcccggatagctgggactacaggtgcgcgccaccacgcccagctaatattttgtattttgtaagtagagacgtggtttcaccgtgttggccagggtggtctcaaactcttgacctcaagtgatctgcctgcctcggcctcccaaagtgctgggattacaggcgtgagccactgtgcttggcgcagttttactacttcttgagacaactctgaagatttctatttttcacagaaagtcattcagttaatctagacttttcaaatgtattgccataaagttatatttactattttaaaattttaatttcctccttaacccaacatttatttaaaagggtcatttcagccgggcgtggtggctcacgcctgtaatcccagcactttgggaggtcgaggcaggtggatcacctgaggtcaggagtttgagaccagcctgggcaacatagtgagaccccatctctacagaaaaataaaaaattagccgggcgtggtggcacacatctgtagtcccagctcctcgggaggctgagatgggaggatcacttgaacctgggaggtcgaggttgcagtgagccatgatcgcaccactgcactccagcctgagtgacagagccagatcctgactgctgctcatagagatctcgcctaaagatcttgcctaagtgcaaaaacacacacacacagaaactggaacaaccgaactgaccctttggggaggctggcgaaataaatgacatggagtacattcatacagctctaaaaaaggacaaaagtcagggacatctgtgtccagggaacactctcgatttgtcttgttaagtgaaactggcgaggcgtggaatcatgagagaagcgtgagtagaggggacttaaaccagggactggtggccacagctagtgttagccaggggactggaggctgggagactgagaaggagattttcttacttcgtacgtgtctgtactgtttggattttttttttttttttttttttgagagggtattttttaaaaggaaaagcttgttttgtttttctttttaaaaaataggctctaaaaattctggagagaaataaaaaaggcaacatggtggccgggtatgggcgtctcttctgattccaggctggttggcactggccaccttgctcaatggttgccttagaaaccggcctagcgagggggtgtcagttgtctctggtagccattaaggcagtgactcagcagaaaacccaacccaagagggagttgttcattcactgactttccttctctcccagaaaagcatgggtgaggccatttctgttacatttgcgatcgggtggcagctgctccgccgtgaaggcggtagcgagaagtctgcccgctcctccagcctctcactaggtgagtggcgtctctgtgctgccctgtccctcagaaaccacaggttccggtccctctgccagcctgtcccctgtctctcccctcccgctgacagggtgaaaccagcttccgctcacaagcacttgctgggggttgccacaggcatggctcttggggagatctttagtaaaaaacccaaccaaacatcacgagtggaaccgagtgtggatcataaactcaactgagagaaaagccaagggacgcatgtgggcaaaatacacagaaaacccagcatgggcgcgggggctctcgcctgtcatcccatcactttgggaggccaaggcgggtggatcacttgaggtcaggagttcgagaccagcctggccaacatggtgaaaccccatctctactaaaatacaaaaattggtcgggcatggtggtggacacctgtaatcccagctactcgggaggctgaggcaggagaattgcttgaaccggggaggcggaggttgccgtgagctgagatcacaccactgcactccagcctgggtgacagaatgaggccctgtctcagaaaaaaaaaaagaatcacgtgctgagacatgctacaacacagatgaaccccaaaatcataatgctaagtgaaagaagccagacacgaaagatcccatgagtattatcccatttatatggagtgttcagagtaggtgaatctatagagacagaaaggagatgagtgactgcctcagctggaagggaaaatggggaagaaatgggtagtgactattaaaaggtatggtgtttttttttctttgtttttgttttgttttgttttgttttattttgtttttttgagatggagtctcgctctgtcacccaggctggagtgcagtggcatgatctcggctcactgcaacctctgcctcctgggttccagcaattctcctgcctctgcctcctgagtagctgggactacaggcgcccaccacgatgactgggcaatttttgtatttttagtagagatggggtttcatcgtgttggccaggttggtctcaaactcctgacctcaggtgatccacccacctcggcctcccaaagtgctgggatgacaggtgtgagccaccacgcctggccagtgtttctttttggaatgatgaaaatatgctcaaatagagtgctggttgcacaagtctgtaaatctattaaaaacacggagttgcacacttcaaacaactgaaccttgtggcgtgtgaggtagatgtcttaacacagctgttaaaaagcccaggatagctgggcacagcggctcagctgtaatcccagtactttgggggggctgaggaaggaggatcgcttcagctcaggggcttgagaccagccttggcaacctagcgagaccctgtctgtactaaaaataaaaataattagctgggcatggtgacatgcacctgaggtcccaggtactcgagaggctaaagcgggggctgtgggcaggagaacaaggctgcagtgagctatgatcacgccattgcactccagcctgggcaacataatgagatcctgtctcaataaacacatgaaagagacacatactgttatttcaaacttcactcaaaatacactgccttctatgtgctgggacccagagagggtttgtggcatgtttgtaggaataagtccggatcagaacggagctgagaatgggtgttcactcgtattcttcaatgtctcctattgagatgatgttatccacttgttattttcttgaccctattttctgccaagaaataaagtaatttgagagagagagagagagcgagatctaacgtggaaaaacagatctgcaggaaggcatggaacgcactagaaaggtaaaaaatgggctgtttagaccaacactaatagtgtcctttgggatttaaaatatacgaaaacaagagcacccgaggcccggcggaaacacagtctcgctgctgggaggctctggcgttgcttgagccactgcaccgcagactcaatccctagggtaactgctggagtaataatgaaaagtgacactgagaaaaggcaaaaaaagagaaagaaagtaaccaacgacagatgggacaacagagaacaaatggtaagctggtcctcacacacagccagagcaggagggtggcgggggtcagggtctaatggtgtggaggaggaggaggaggatgttgagggtgaagaaacaaagcccatgcccccgagttgtacacttataaatagttaaacagatgaatattatgttgtatatattttatcacaataaaagatctcacatacagccatattggcaaatccattaaaatgaaaatggataaacacacaaagattgccgggctggcgtagagggaaaataaaaccaatcaatcaatatgctgcctcaaagagacattctttctttcttcctttctttccttccttccttcctttctctctttctttcttttttgacagagtctcactctgctgcccaggctggagtgcaatggcgtgatctcagctcactgcaacctccatctcccggattcaagtgattcccctgcctcagcctcctgagtagctgggattataggcgtgcaccatcataccccactaatttttgtattttcactagagacagggttttaccatgttggccaggctggtctcaaactcctcacctcaagtgatcttctcacctcagcctcccaaagtcctgggattacaggaatgagccaccgtgcccggctgcattttattttattttattttatttttgagatggagtcttgccctgttgcccaggctggagtgcagtggcgtgatcgccgctcactgcaagctccgcctcccgggttcacgccattctcctgcctcagcctcccgagtagctgggactacaggtgcccgccaccacgcccggctaactttttgtatttttagtagagatggggtttcaccatgttagccaggatggtcttgatctcctgacctcgtgatccacccgcctcggccttccgaagtgctgggattacaggcgtgagccactgcgcctggcccattttatttcttaaaaacagcttttttttttttttttttttttttgacagagtctcactctgtcgcccaggctggagtgcactggtgccatcttgactcactgcaagctccatctcctgggttcacgccattctcctgcctcagcctcccaagtagctgggactacaggtgcccgccaccacgcctggctaattttttgtatttttagtagagacagggtttcaccatgttagccaggatggtctcgatctcctgacctaatgatctgcctgcctcggcctcccaaagtgctgagattacaggcgtgagccactgtgcctggccaaaaacagctttattgaggtataattgacataaaataaactgcacatttaaagtgaacagtttgaaagttatatctgccaaaccatcaacacaatcgagaatgaacccaccaggccaggcgtgggggctcacgcctgcagtcccagctacctgggaggctgaggtgggtggatcgtgtgagcccaggaattcgagaccagcctgggcaacatggcaagaccccatctctacaaaaaatacaaaaactggccggaactgggatctggaaggcggaggggacgcagtaggcatttgtgcactgtgagtcctggtgtggggccatcgcagcactgccagctcccatcaggtctccctgatcagatgttccaacatgtgtatacagatgtgtacaacacccaagagaaatgagtgtgtatgtgcagcaagacagattcggaaatgttcataacagctttatgccagccccaaactcaatccaaacgcccaagagtagaaagagtcaaatgcggcccattcttacaatggaacgctacctgggaaggcaaagcaatcgcttagcgctactcacggctgcaacagaacaacagtgcagagcaatagcaggcagacgcgagttcgtaccacgtgtgttaatccattctcacactgctgtacagaaatagccaagaccgggcaatttatatagaaaggaggttcaatgggctcacggttctgcaggctgtacaggaagcatggctgcatctgcttttggggaagcctcaggaagcttccaatcatggcgggaggcaaagggggagcaggcacatcagatggccacagcgggagcaagagccggacagtggaggtagcacacactgttaaacaactatcatgagaacagcacccagggatggcgcggaagcattcatgagaaatctgcccccatgacccagtcacttcccaccaggccccgcctccagcactggagattggggcagggacacacatccaaactaaatcacgacacaatctcattgacatgaaattccagaacatgcaaaactatctatgtgtttaaagccaggtttggatgttctctggtgctactctcatcaaaaaaggcggcccacagcgcctctccccttgcatacactggcctcagaggcttgcgtctagtgagcaggctgccggggaagtggcagcacctgatccccaggccaggccatcagatgacgtggcctccgctgggctttctagcttgagatgctccccggagaacccagcctcacaggcacatggaggtgtcctcaccccggcagcgtcctccgctggacacgaaggagccgctgggtggttccagctcgtggccatcgggctgccccggctaaccgactgcagcgggtgagctctgccaactgagacctcacagagcacaggctcgcgagcaaaacaaacattgccattattttcagcccgtacatcttggggtggcttggtacctagcaagagataactggagcagattcatatgtgggtctatgtggtggctgccacatggccgtgtacatataaaacagtcattgggctgtacgagtacggtttgtgtacttttctacctttaacttatacctccctaacaaagtctttcagaaaagcctaactcctgaggctctggtgtgggcagctgggtgggcgctggaactagtcccacacgctgaggtgggaagctcatggtgaaagggaatcccaagtctgcttggccatctaagtttacggtgcctgtgagaaaaatcagaaggccaaaacctcaggagagagagcatgacggaggcgctgccgtttgggaatggacatgatagagccgtgagaatgaggaagatcaccgtcgggaatgagtgcaggcagctaagaaggcgcagaggcgtgtctggagggactcacaccttgtagaggctgggtagagagagcccacgcacgctgagaaagaacacagacttcagcgtcacagaggtcacaagagacaagcggttggtgggggagtaggcaccggcgagagaaagtccaagaggactggatggatttgacaacacggagatccctggtgttctggatgaacgctgattggatggagtggcaggggtagaagcagaggaagagggactgcacagggaatgggcaagtgagaaaacagacaaggattctgaaaagtttagctacaaagaggaacagagaattagggttgtggttggagggggtgttgggtcaaatgagtttttatttttattcttcaagaacggaagctaccaggacatgtttgatgaaaatagatccagaggccgggcgcagtggctcacgcctgtaatcccagcattttgggaggccgaggtgagcggatcacctgaggtcaggagttcgagaccagcctggccaacatggggaaaccccgtctctactaaaaatacaaacattagctgggcttggtgacacatgcctgtagttccagctactcaggaggctgaggcaggagaattgcttgaacccgggaggcagaggttgcagggagctgagatcatgctgctgcactccagcctgggtgacagagtgactctgtctcaaaaaaaaaaaaaaaaagaaaagaaatagatccagaagcaaggaagaaattgatcatgtcgggtgacattatgagtgaagaagtcctcagaaaagaggagaaacttgcaattctggccacagtggaataactgatgccagttgtaaacacctaaaacactgggcaactatttttagatatcggacaataggctgtgcagggctgtgaccagagagaaaacaaagaaggtgagccttacaagtaccctgagtttctgcctggaggcactttcacaccatggttcagcaaaggggcctgagcggaaccagcagtctcactgaattactagagcgaccaagccaatagcagagaaaaaacagaatcccagaaatatgtaattaatccaaaagtcaaaacagatggggtaatagaaaacaaataacaagatgatagacttaactccaaccattaaatggaaatggattaaacagaccaactaaaggcagagattgtcagattgtttaaaagaataaggctgggctgggtgccacggctcacacctgtaatcccagcactttgggaggctgaggcgggcagatcacttgaggtcaggagttcgagaccagcttggccaacatggtgaaaccttgtctctactaaataaaaatataaaaattagctgggcgtggtggcacacacctgtagtcccagctactatggaggctgaggcagaagaatcgcttgaacctgggaggcggaggttgcagtgagccaagattgcaccactgcacttcagcctgggtgacagagtaagactcttgtctgaagaaaaaaaaaaaaaaaaaaaaagccgggcacagtgcctcatacctgtaatcccagcactttgggaggctgaggtgggtgaatcacctgaggtcaggagttcgagatcagactggccaacatgttgaaaccccgtctctactaaaaatagaaaaatcagtcgggcgtggtagcggacgcctgtaatcccagctactcgggagactgaggcaggagaatcacctgaacctgggaggcagaggttacaatgagccgagatcgcaccattgcactgcagcctgggtgacaagagcgaaactccatctcaaaaaaaaaagtaaatatacagacagccagggacaggtgcagtggctcacacctgtaatctagcactttgggaggccgaggcgggcggatcactggaggtcaggagttcgagaccagcctggtcaacatgtggaaaccctgtctctattaaaaatacaaaaaaattagccgggtgtggtggtgggcacctgtaatcccagctactcgggaggctgaggcaggagaatcacttgaacctaggaggcagaggttgcagtgagctgagatagcgccattgcactgcagcctgggcaacaagagcaaaactccatctcaaaaaaagaaaaaaaaaaaagaatttaaacaaggtcacagaatatacggttcatatgcaaaactcaaccgctttttttttttttttttttttttttgaggcaaggtctccctctgttgcccgggctggagtgcagtggtggaatcatggctcactgcagcctcaacgtcctgggctcaaactatcctcctgggtcagcctcctgagtagctcaaactacaggcatgcaccaccatgcctggctaatttttgtactttttgtagagacggggtttcgccatgttgcccaggctggtctcaaactcctggcctcaagtgatctgcccgccttagcttcccaaagcgctggaatcacaggcgtgagccaccgtgcccagcatcaattgcatttctgtataatatcatgatgaactagaaaatcaaagataccatttagaatagcataaaaaacatggactacatcaggaaaaacctgacacgggaagtgctgggtgtggccagcccagagtagtaacaagaccctggacgctcaagaaccctgaagtgtaaggcatcaggaaagctcaaggctttcggtgcaacaaagtccacaagtagagcccgagattgcaacatacgtttttattactcaaggacaacctggacgtcaccaatgcccagcttcacgggggcatgtagtgtgactcacggctgaacacaaaatcactgtgaagcctgtgctacagccctgggctacttttggacacgcaagaggacactcggttacatgaaacctgacttgcttctgaagacatgtgatacatgtcttttccctgaaaatgtttcccttccctgtctgccatgctcccaacttttctgccttccaggggcttctcactgtctgggtaactaggtcttgggcctagctagaccttgggtagtggcccctctgccacaatcagtgcctgggcctgaggctgagcttgtggcctccgaagcctgacctggctcggagctcgtctgtggcgcccagggatggcctggcttgcaggccaccacattaggccagctcgcaggtccccagtaaagcctgaagacactggcccgaggttggaggtgggtgctgctcgactttctggaggatctcagaattctcgcttcttgctaggactgaaccatgagacttacagccatacttcacttttcccagggtttttctttttgaaacagggtcttgctctgtcacccaggctggagtgcagtcatacaatcatgactcactgcagcctcgacctcccaagcataaatgatcctcctacttcagcctccccagcagctgggaccacaggcgtgcgctaccacgccaggctaatagtttaaaaaattttttggcagagacagggtctcatcatgttgccctggctggtcttgacctactgggctccagcgatcctcctgccttggcctcccaaagtgctgggattacaggcgtgagccaccgcacccggccacacttttccaaattgtaagcaggtaggagggccctaggcctcgtcggccccattgtgcagggtggccactgtccaaagagatgggcaaagagctgctgccagaggcctgggctgcagacgccctgcatggctctcaggggagccagctccctactccacacccctgcacagcagcccctctcctcccctcacgggtctgtgcagccagcagcctcccaacatgcgccagcctcctcactggatgatgccagccttccttgcccccagatgctggcatggaggcagggttccactctgcctgcctatgcccacagagcctagaacagcagggccacctccttctctcccccgcgggcatgggcccccacccccactgccggcagagtgctgaggactcgtgcaccatgagaacttctgaccatgagaactttgacttccggatttgggggatctgcccaggtgaacacatcagctctgaaattcatcactttcttcgggcccctgcctgtcctgttccaggcccaagcctacagaaggaagaggaaagtccgcttagcaaatgggggaggctcccctactgccagaagccctggctcaaggcctgggccatgctcccttatctcctggggcgttcgtgggaattgagggtttttgtttgtttgttcatttgtttttgagacagggtctaactgtctcccaggctggagtgcagtggcttgatcacagctcactgtagcctccacctcctgggctcaagtgatcctcccatcttggcctccaaaagtgctggtattataggcatgagccacctcgcccagctgagggttcctaagcagtggttcttcaaatagtacctgggatggaaaattcctgctggggcttcctatttcctgaaagcacagagtggggcaggcaccctcgggctaaaggaggtgctactgtcaggaggcgagggaaggagtgggccagggtcttgctaagggaggcatgtggggccggctgggcttctagaggtcgccagagccagtggcctgcccggctgccccacgccctcagcgcagtcgggacagacactctgctctttggggctgacacggatgcgcctgagcaccccagaggccagcctgggcggcagcacctgggagggagctggacgacagcagctgcaggctgtccagggccccatcctcgtacagggccagcttctggaccatcttctgtcgggcagggttgatgataatctgcggtggctctgacgacgatgatgcagagctgccaagggccagtcctggggtggagatggcactcccttagcctcatgctgtggctccccagcccgcagcctagcaccctgcctccctggcctcaggcctgaattcctcagagaagtccaagggcagggcccagctctcaggctaccagacagagccctccttgttcccagccttcaggaatggggtggggggagggctggagagcaagctccacctgggaaggatgtggcctggggaggggaaaccagggttgctaaggtcacagtgagctgaacatttggccctggttctcttctagaaggctggggtggggacttacaggggctttggcccaaagaggccttggtccctctcctgggaacccgtctccccagctaccttccacggctgtgggccgggatcctgggccactcccccagctcgattctcctgccgtgtccccctgaggacagccggcctccctgaggggtgctgggtccagagggcagcttggagtcaagtgccaggagcgcagggcagcagagaggccgcctaggctctcgtcactctccacgggctggttggggcctctctgcagctgctctgctgcctgggcactggctcctgatggcgctgccaggggctgccatggagcagccccactgtgggctctgccagtgctggacacgtaggagttctcctgcggggaaggggggatgcagctggcggcctccgaatgcccgggcacccccgccaccactgcctgcagcttctctagcctctcgtacacctgcaagtggaaaagagggactctcagggtgagatggcagccctggccggtcaccccgtgggcaaaccacagggctgctccaggccgtccgtgacctgccccagggctctaaaatgacataccctgcagctgggaacgctctgcccctcgcccctctgttcccatcacagggagtgctgagaagcgcggctgccaaaagcaaggactgagaatggcctcgttcttttctacaaaatgaatctcactgccccgctgccctcaaacggggcctctccattttcaactgtcaccagaggagaagaggtggggtactagggaggggacagaaaaaggcagatgcagtagtgcagtgcgcccagcagggggcgcggcagcagctctttccttctctctatgtgaagggggtcggagctgggctccgcaaagcaggactgcccggggcccctcagttcagaggggcgctgccccaaacagaaccaaagggcaagcaagaaatgtgtggagactccagagagacctagcaggtgctgagatggggtcactacagagcaaggcctggaatgcgggctttctatctggccaccccgtcccagtgcgcagctggctacctgggtcataggaggcctccttttggcccggcggtgcaggcagcagcaggccagctggcccaggcccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcggacactgactcacttccccttcgagccggcctcgtgcgacgcccggcggggcggaaggggcggtgcccgggcccgccgccatcttgcgcgccgcggccgcgcgctgggtcacacgggggcgccccgcgccggggagggcccgggtcccggcgggttccgcgagcggcgatcggcctcccgggctcgcccgggcggggctctggaggacgaacggcggctcccggcgttggggacagagggcagggcggaggcccgggctgctcggaaaggggccggggccgggccttccgaaagctcctgggcggccctgccggaaccctgctctccactgcggcctgcagggctgttaccaggagccctgcctgcccgccccacgtctagccccctgcacacggcagcagccttgagccattcagtctccttaggtgtcctgaaatatgccgagaacgctgcccgccacagccgtgagtgtatgcgttgctgctgccccagccctcatttggcaagggtgagctcaggcagctgtggtgaaggcttcctgagcccgccggcagagctcctgccaccccgtacctgtcccctcctgggcatcgtccttgattacttgtctggaccgccacccccggtccccgccctgagatggggaagaccccacaagcagcaacgcagacttactcttttgtttctccagctggatgtctcctccagcgacagttccccttgccctcttgatcctgacagcgaaggggttccccacccctagccctacagacttaggacttttcctagaaacgagaagtgcccaaggcccacagctggcccctgttggagtctctttcctgaagccaccaccactgtggccactcccaaggaagatgccaaccataccatgaaacccatggcttctcacgggacagactttactgagatgtaccaactcaagtatctgaaatgactgcacacccatgctaacctccacgggggcacttggtcctacttacacacaaaggcccatcagctcacggaacagggctggcatacgagatgctcaatgcatacaagttgacttttcaaccctgggatctacctttgaaggccaggccttccgagggtaccttctagcatgtgcatgtgaagctggactcctttgagcagttgtctcctccagccccttaccaacctggtgaggctgctcctgagagccaaggaagccagtaacaagggggccccctttgggcaaacccctcagcctgcccttgcctggtcagagaaccacgttagcagtcaacagagggcacgtgagggtcctggccagaatgagacacaggaggagccacagcctgcgggggtgggggtgtccaaaagcaccacagcacatccagacctagggggtgcccctaccatacgggtctggagcagggaggttgtgctgcaggctgactcatgccaggcccttcccgtcacacgctggagcagtgtgcctggagagcactggcttggaagaagctgaggggccagcgaggccagcatatggaggaggcttcccttggccgctcgtggcaggcctgaaggcagctacctgtgtccagggacagccagatccaatgaggaaacgcagcaccatgctgtcatgtgagctggagggggacttctgtcttataatgaaagcccagaccttgagtcactttcacagagagatttatcgagaatgctaacagcacaggatacagtacttcccaacaaaaggtgcaaacgcgtcacttagaaaggcatgctgagtattctttgctttcacatgtattaaaaaacttacaaaaataaaataaaactgcgtgctgcccatcttttccaatagtaaaagaaccttatgaaaaaatcacttgatttttacaacaaaagacacaaacggacatttttatgtaaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgggaccccgcacggccgacgtcgcgccccgccctcttggccggcccgcgcgctgctgcacctgcgcgcccgcgccccgccctcggcgccgctgcgagcccgcccgtcattggctgtgatggccgggctgggacggggaggacgggggaggggggaggtctcagcggcgatgccgtcaattggcgagatttcctgtccatttcggccagggaaaagggggcggacccctccagctgttgattggctgctttcggccgtcgtttggggaaaagaggcggcttgggcgcggagggactggtttagtgggcggaatttgaatgttaaggattaatggacccttgcggatgctggggcaagtgaaggcctaggcttgggacgcctgtttgcgctgctctgaggggcgattgaccctctgtccacagatgcaccgagtgcgctgcaataagcgtttcattgcacccacattttctcaatatcactatcttcggcagaagcagcaaagttgcccaccctggagcctgacgttgccccagctgaggggccttggtttcagaggcctactcaatgcattatttcatccgagcctgcccagtgctcacactctcatagaggcggggaataaactgacaacaaatcgcaaccctggctttcgcagaactctggcgggggaagagagtgcatgccaaggcctcgtgacacctgtcactgttggatcagatggtttggtggaggtgtgaataaggggcaatgttagctctgcctggaagatatgatttgggagctgagatccagcaatttttcactttcctagaagagttgatttggagctgagatccagcaattgtgttttgggaaaataagagtatgagaaaactgttagctaaccaggtgttcaggacaggagtgtttgttaaggggaccttaccctgatgccagtcattatccaatccattcaatgatccttctgttagttctatgcttagcaagaaaacctgattctgatttggctgcttgcccccattcatttattgactacctgctatgtgccaggcactcttccaggctctggatgcacggtactgaacagacagcaaactaacattcttgccgggaagattcatactagcatacaaataagtataatatatcatttcacatagtgataagggctttgagaaagataaactaagtgaagggggtgctatttagatatctgctggttttcaccctcattttactccctcatatgaatatctggggaaagaacattccaggcaagttcaaaggacatgaggagagactatgcctggcatgttggggactaacgaggaagtcagtgttgctggagagtggtagggaatgtgattggaaaggcagctggggccactatgagaactgggagttcattcttttttggggggggtggggatggggtctcattctgtcacccaggctgcagtgcagtggcgcaatcttggctcactgcaacgtccaccctgagctcaagcgatcctccctcctcagcgtcctaagtagctgggaccacagatgcgaaccaccacgcctggctaagtttttgtatttttgatagagatgggagttcaccatgttgcccaggctggtctcaaactcctgagttcaagtgatccgcccgcctcggactcccaaagtgctgggactacaggcgtaagccaccgcacccggccagaaccgagagtttattctaagatgagaagccctcagaggattttgagccaggagctgtctgatctatgttgcaggtgtagagtggagaactggacgtgatgaaacaaaactacagcacaaggctagttgcaaggccctggaacagtctaggagaaagagttgatggtagctttaactagggtggcagcagtgcagctctgagaagttgtgagattcaagatatgttttcagaactgaacaaaaggattggatgtagggcatagagcaagggaagaaacaaggatgattcctgagattggggcctgagcaactggggaaataagggtgcttttcaccatagtggggagaactacaggaaaagtacattttcagaggtgcagatcaagagttctgctttggctgtattaagcttggggtgcccagtggtgtgaaagtggagatgttgagtaagccattgggtgtgcgatgctgaagtatagagatgcggctaaagcagtccaaaagtcatcacgctgaacatccaattcaagaagccataaagaaatgacagagtaagcctgcaaaagtagaagaaagaaaaataaggatgaataaaacttaatgaaatagaaacaaatgatggagaggattgagaaaattttaaacctgcttctttgaaaagctgaaaaacaaaagccaaccctctaacaagctggatataaagagaaaagagaaaagtaaattatgttactcatgaaaaggttttattatgcactgtgtgtcagtaaatttgaaaacataagcaaaaggaatacattcctaggaaagtacagcttaccaaaaccgactttagaaacagaaaatccctgtaaccacaatgaaattgactatgtatttaaaaagctacccatcctcctacacacagacacagacacgcagacacacacagacacacacgcacacagagagagagagagagagagagagagagaaacagaccaagagggctttatggatgacttctaccaaatctttaatgagtaggcaattccaatcatacacagaaaagaaataaatgtctccaaacttattttactagactaatatatctactatgatgagccaagaaaagtatgacacaagatgtggaaataagttttaaaattctagacaaataaactgaatcctgcagtatatgatctatcacaaccgagttgagttttatcctaagaatgcaaatatggtttaaaattagaaacccaaccttaacaaacttaaggggaaaaacactacataattatttcaatagatgcagaaaaagcatttgataaaattcaacatctacttatgattttttttaaaaatcagagaactggagttcaagacaagcctgggcaacatagcaagaagcaagaccccgtctttacaaaaaaaatttaaaaattagacagacgtggtggcacacacctgtagtcccagctccctggaaagctgaggtggaaggatcacttgagcccaggagtttgaggctgcagtgagctatgattgcacattgcactctagcctgggcaacaaagcaagaccctgtctttaaaaaaaaaaaaaaaaaaaaaaaggtgaccaggcacgacggctcacgcctgtaatctcagcactttgggaggccgaggcaggcggatcacgagatcaggggattgagatgatcctggctaaaatggtgaaaccccatctctactaaaaatacaaaaaaaaattagccgggcgtggtggcacgcacctgtagtcccagctactctggaggctgaggcaggagaatcgcttgaacctgggaggtggaggttgcagtaagccgagatcgtgccattgcactacagcctgggtgacagagcgagactccatctcgaaatagatggatggatggatggatggatggatggatagacagatagatagatagatagacagacagacagacagacagatagatagatagataaaataaaaggttaggagagggcaaaaaacctgaatagacatttctcaaaagaaaacatttaaatgaccaacaggtatatgggaaaaatctcgccaggcaccttggctcacacctgtaatcccagcactttggtaggccgaggtgggaagatcacttgagtccaggagttcaaggccagcctggttaacatggcaagaccactgtctctaaaaaaacaaaaaattagccaggcatggttgtgcacacttgtcatctcagcttcttgggaggctggggtgggaggatcacttgagcccaggagtttgaggctgcaatgagccaggatcgtgccattgcactttggcctgggtgacagagtgagaccctgtctcgaaaaaagaaagagaaggaagggagggagggagggaggggaaaaaaagttcaacatcactcatcatcagggaaattcaaatcaaaagcccaatgagataccccttcaattcagttagaatggctttaatcaaaaagacaaaagaagacaagttggcaaagatgtggagaaaagggaatactttcatactgttggtggggtagtaagttagtatagtcaactatggagaacagtatggaggtttctcaataaattgaaaatagaactaccagcaatcctactaccggtatatatccaaaggaaatgaaatcagtatgtggaagagttatctgcactcccatttttattgaatgactattcacaatagccagatacagaatcaacttaggtgtccaccaacaggtgaatggataaagaaaatgtggtacatatatgcaatggaataatattcggccataaaaaagaatgaaatcctgtcacttaagacaacatgaatgaacctggaggacataaagttaagggaaataaaccagaaacagaaagacaaataccacatgatctcagtcatatgtggaatctcaaaaacaaaaaagagttgatatcatagaagcagagagtagaacagtagttaccagagactggggagaggatcggggagaggaggatgggcagaggttggtcaacaggtacaaagttattattagataagatgaataaattctggtgttttgaccaggtgcagtggctcacgcttgtaatcccagcactttgggagactgaggtgggtgactcacttgaggtcaggagcttgagtgcagcctggccaacatggtgaaaccccatttctactaaaaatacaaaaattagctgggcatggcggcgggtgcctatagtcccagctgcttgggaggctgaggcaggagaatcgctcgaacccaggaggcagagcaacctggtgagctgagatcacaccactgcactccagcctgggtgacacagcgagattctgtctcaaaaaaaaaaattatgttgttctattgcacagcagggtgactatggttgacagcaatatattgtatgttacaaaatacctagaagagagacttttgaaagttcccacaacaaagaaatggtacatgcatgagctgatggatatattaactaccctgcttggaccattgtgcaacataaatatatattgaaatatcaaattgtactccctaaatatgtgtcaattaaaaaacaaaaataaaaagccccacatacatccttcttccattctcttttaaacctcattcttggtgcgtctctgcggggagaaaggcccatttcaagtcagttccccggtgttaggatgcaggcatgtaaacacgaccagtaataaaaagctggaaaatgtaatgagggaaaaaagattcaactcactctcactacaaaaattataaaacagctgggaataaacttaataagaaatgtcaaaacctgcatcaaaaagctataaaactttactgaaaaatctaaaagaagacctgaagaaaacaaaaacaaaaacagacgctaccgtattcctggaggggaagcattaacattatagaaatgttaattcttcatcaataactctggaaattctttgctcaatcaaaagtcaagaagtttcatgggctataacaacttaaatctagattggaaagaataatgtacaagactagaactcaagaagtttttgaaatattaaaaaataatgaagagaatcttgctaaattccttaggttgaatagaaggaacttaagttatacagtttcacacttgccattgaaaagtagaaaaatatactataatcggctgggcatggtggctcacgtctgtaatcccagcactttgagaggccgaggcgggcagatcacgaggtcaggagatcgagaccattctggctaacaaggtgaaaccccgtctctactaaaaatacaaaaaattagccgggtgtggtggtgggcgcctgtagtcccagctacttgggaggatgaggcaggagaatggggtgaacccaggaggcggagcttgcagtgagccgagatcgtgccactgcactccagcccgggtaacagagcaagactccatctcaaaaaaaagaaaaaaaagaaaaatatactataatcaaaattatttactattagaattaaaaatcagtaatttaaaaaatgggactgtaatagtttaaggtcctcttaaaaacaggactgtagaagataaaaaccaggaaaatctagtatagatggtaattgacagaaagcccacaaccagaaggattttatcaatatgacaaacaacacaaacttttactccatttgtctaaaaatctcttaaactgatagagaatatatatatttcagaagagctaatccaggccaggggcgctggctcatgcctgtaatcccagcactttgggaggccaaggcaggaggatcgcttgagcccaggagttcgagatcagcctgggcaacaaagtgagaccccgtttttcccaaaaatgaaataaattagctgggcacgtgcgcacctgtagtcctagctactcaacaggctgaggtgggatcatgccactgcactccagcctgggagaaagagcaagcccctgtctctaaaaacaaaagaaatgaccaacattgagagccctacatattaaaacctaggagataaggctacagaggtcacctagaaaaattaatagccttaaccatatttgttagaaaatagataagaaatgaataaattctgatataagacaccatgagcaggcacagatgtgcatgaacacacacacacccagacacacagacacacacacacagtcacatacacagacacacagacacacatacacacagacacacacacagacacacagacacagacacacacacacacacacagttttccttctttactcatagaagtgcactaaaagaagaatgtcaagaaacagaaaggaggcagggtgtggtggctcatgcctgtaatcccagcactttgggaagccaaggagggtgaattgcttgaggtcaggagttcgagaccagcttggccaacatggtgaaaccctgcctctgctaaaaatacaaacaattagccaggcctggtggcacgcacctgtaatcccagctacttgggaggccgaggcaggagaatcgcttgaacccaggaggcagaggttgcagtgagccgagatcgtgccattgcactccagcctgggtgacagagcaagactccgtctgaaaaaaaaaaaaaaaaggaaaggaataaacccaccagagtgaagagaatgtggtgaggatgagaggttatcatcaaaggacaacaactttatagaaagcatatgggaattgattgatgaataaaataggcagtaaaaatccaggtgagaatatttgacaagggagccacagaagaagtgggagtgagtttgctagatataacaccagacaatcagaatcagtaggcatgtggtagaaaacgatagaattaaataggactgaacacatggggattaattgaaggcaccagtacagaatgactgtaccagttggaacctcctctccccaccagacagctgagctgggagctggcacagacctacagggaaaacacctgacagttctgtaaagaaattgattgaaatgtcggtggagagctaaggcttccagcatggatgctgacaacccctgaacaattgtttcctcattccggcatctaggggatactctgttcgtcacctccctgtcctacacagagaagagtcacagcaggaaaacagacctatttgcccaacagcagattaaatccacaatacttatccagtccttccttattaaatataaaccagtcagtaaatattatcagaaatttgatgaaagccttcaacaggaaaaagagtcaagataaacctgtagaaaaaatataaacttggaattcaagaaaattcagggaatgtatcaaaaaatttaatttaattaacatatctacagaactaaaagaaaatgctgtattcataaaacaagaacagaatattatgtaaaaagagcaatcagagaacaagaaggaattattgaaattcaaatttcaatagaaatattggaaaataaaactgaagaagtctcccagaaaatagaacaaaacaatagagacaaagatatgagagaaaatatgaggactttgaggagtgatctaggaagtctggcaagcaactaacaagaattatggaaaaatgaaataaagaaaaaggaacaggaatcagagtagcaccagagttcataacaacactgaatgataaaagatcacaggacaacaagaaaagaaaaagataatagggcaatgctttccaaattccaagggaaaatgattttccacatagaagtacaccatccaaaatatccattatgtgtgataatggaataaaaatgtttttagatacacaagagctaagaaaatttgcctctgaaatgtactttcttaggaagctacttggggatgctctgcagcaaatcaagggtgcaagccaagaaaaaggaaaatgtgggatccataagacaatggatctaatccaggagagctgtgatgggaaataccagggatgccaactgggcagaaagcctggttggcaatcagtccaggttggagtaggagaatggtaggctctgggagagaggactccaagaattaaatatatatgtatagccgggtgtggtggctcacgcctgtaatcccagcactttgggagactgaggcgggtggatcacctgaagtcaggagctcgagaccagcctggccaacgtggcgaaaccccgtctctactaagaatacaaaaattagccgggcatggtggcgggtgcctgtaatcccagctactcaggaggctgaggcaggagaatcgcttgaacctgggaggcagaggttgcggtgagccgagcttgcgccactgcactccagcctgggcgacagagtgagactccgtctcaaaaaaaaaaaaaaaaaaaattgtgtatatgtgaattcaacatattagatggtgtgattgggagtctgaagttggatacgatgatggcaaatagtacaagaaaataaggaaaagcaattaaaaataccagaaggaaagaactatacaagaaagttatgatccgcaaggagccgtggctcacgcctgtaatcccagtactttgggaggccaaggcgggcggatcacgagttcaggagatcgagaccatcctggctaatgcagtgaaatcccatctctactaaaaaatacaaacatttagccgggcgtggtggcgggtgcctgtagtcccagctactcgggggctgaggcaggagaatggcgtgaacccgggaggcggaggttgcagtgagccgagatagcgccactgcactccagcctgggcgacagagtgagactccatctcaaaaaaaaaaaaaaaaaaaaagaaagttatgatcaaaacaagaagcaggccgggcacagtggctcaagtctgtaatcccagcactttgggggtccgaggtgggcagatcacttgaggccaggagttcaagaccagcctggccaacatggcgaaaccaacatgtccctactaaaaatataaaaattagctgggtgtggtggtgcacacctgtgatcccagctactcaagaggctgaggcacaagaattgcttgaacctgggaggtggaggttgcagtgagccgagattgcaccactgcactccagcctgggtgatagagcgaggctccatttcaaaaaataaaaataaaataaagaaaaaagaaaaaagccagaagtaaagtaaaatagatcataattttcctaattcatggtaagaagagaatcattgggacctgggtgctaggaaagttctcttttcaaatgactcagggactatcgaattagacgtataagaaagaaatataatcctagcattcctcttcttgacctggcactgaaaatatttacatagactttctaatgtgaatttttgtttttgcttttcaggttttagcgtcaacctatacacaaaacatggaaggataggtttttgttgctggatgggacacatttctctcctctttctgtgtagcaagagttaactccagcaggcctgggtgttcctgcaggtggtattggggacccccacacctgatatatgaccatgtatgtaacaccatccactgttatctttagttctttgtatgtttaaataatacatttaaatctcttgttccattagctttcactagtaaagttatctttgaccattttgcatcagctacactttaattttacattgtcggggttacttttttttttttttctttttgagacggagtttcactctgttgcccaggctggagtgcagtggatggtgctatctcggctcactgcaacctatgcctcccgggttcaagtgattctcctgcctcagcctcctgagtagctggggctccagggtgccacacactcttaaacaaccagatctggtgagaattcactcactattgtggggatagcaccaagaggatggtgctaaatcattcatgagaaacccacccccgtgaaccaatcacctcccacttggccccacctccaacagtggggattacaattcaacatgagatttgggtggggacacatatccaaatcatatcagtctccaagtgactatttcatcagtttagagtcgccccaggaaaacagaaaccacttcgacttagggcactaaataccagggaaagggtacccaggactacttggaggttgataggggatcagcacagcccacccgaggttggggggccacagagagaaggcctagaaccacaggggccttttggtaggagctgcagctgccgccgagctgctccccccacttcttcttccctctagtctccggctcgggtctcctatggtcaaacccagccagaaaccagctgagcctggatcctgggacaggcaggcaacaggacctgcccctgcagggtgagggagagggaaggccagatttctttttaaagactttatattttagagcactattaggttcacagcaaaattgagaggaaggtacagagaattcccatattctccctgtttccatagttttatcttttccagaatgtcatagagttgaaatcctacagtctgtagcctcttcagattgccttctttcactttgtaatatgcatttaagcttctttcaatgttttttcatggcttgagagctcatttctttttagcactgaatgatattccatcaactggatataccaccgtttatttatccattcacctactgaaaggcatcttgattactcccaagtttgagcaattatgaataaagctgctataaacatccatgtgcaggtttttgtgtggacataacttatcaactcctttgggtaaataccaaggagtgtgattgctggatcatctggcaagtgtatgtttagttttataagaaaccaccaaactgtcttttagggtggctataccattttgctctcccaccagcaaggaatgagtttccattgctccacatcctcaccagcatttggtgttatcagtgttctggattttggccattctagtaggtgtgtactggcgtctcattgttgctttaatttgcatttccctgataatgtatgatatggagcatcgtctgatatgcttatttgccatctgtctatcttctttggggaggtttctctaaagattttcgacccaattttcttgtttgtttgttttttgtttgtttgtttgatttgagacagagtctcactctgtcgcccagattggagtgcaatggcgcagtctcgtctcactgcaacctctgcctccaaggttcaagcgattcttctgcctcagcctcccgagtaggtgggattataggagcacaccactacgcttggacaaatttttctttctttcttttttcttttcttttttttttttttttttgagacagagtttcgctcttattgcccaggctggagtgcaatggcgtgatctcggctcactgcaacctccgcaattctcctgccttggcctcccgagtagttgggattacaggcacccaccaccacagccagctaatttttgtatttttagtagaggttcaccaggttggtcaggctggtctcaaactcctgacctcaggtgatccacccgccttggcctcccaaagtgctgggatgacaggcgtgagccaccgcgcccggcctctttaattgatttttgaatgttgagccagccttgcctacttgggataaatcctacttggtcatagtcataattctctgtatacattgttgaattctatttgttaatcctttgttgaagatttttgcatctatgttcattagggatattggtctatagttttcttggtatgtcttctggttttgacatcaaggtgatgctagcctcatagaatgcattaggaagtattctctcagcttcttctgaaagagatcataaagagctggtatacagttatgcatcacttaatgatggggatatgttccaggaaatgcatcattaggcaatttcattattgtgtgaacatcacagagtgtacttatacaaacttaaattgtagcctatatggattagcttattgctcccagtctacaaacctgtacagcatgttcatgtactaattttgttggcaattgtgacacaatggtaagtatttgtgtatctaaacatatcctaagcattgtaatccccatcatatatgtggtctgtcattgagtggaaggctctgatgtgccacatgactgtaatttcttccttaaatgtttggtagaattcaacaatgaacccatctgggcctggtgctttcttttttggaaggttattaattattgattcaatttctttaataggtataggcctattcaggctgggcgcagtggctcatgcctgtcatcccagcactttgggaggccaaagtgggcagatcatctgaggtcaggagttcaagaccagcctggccaacatggcgaaaccccatctctactaaaaatacaaaaaaaattagccagctgtggtggtgggcatcttcaattccagctactcaggaggctgaggcaagagaatcacttgaacctgggaatcagaggctgccgtgagaggagattgcaccactgcactccagtctggccaacagagtgggactctgtctcaaaaaaaaaaaaaaaaaaaaaaaaaaagatataggcctattcagattgtttatttcttcttgtgtgagttttggcagattgtgtctttcaaggaatggattcattttatgtagattccaaatttgtgggcatagagttgttcataggatttctttattatcctgttaatgtccatgggatccacagtgatgttctctctttcatttctgatactaataatttgtgttctctatttttttcctagttagcgagagccatacaaattgtattattcttttcaaagaaccagcttttgatttcattgattttctctattaatttactgtttttaattttattgatttctgctataatttttactttaaattttattttatttttattttctgtagagatagggtctcactatgttgcccaggctggtctcaaactcctgagctcaagcaatccttctgcctcagcctcccaaagcactgagattacaggcatgagccacagtgcctggcctgccataatttttattattccttttcttctgcttactttgaatttaatttgctcttctttttctagtttcctaaggtggaagcttagattattcattttagatctttcttcttttctaatatatgcagtcaatgctataaatttccctctaagcactgcattcacagcatcccacacattttagtaagctgtgttttcattttcatttagttcaaaatacttataaatttctcttgagatttcttcttttacccatgtgttattcagacacatgttgtttaatcttcaagtatttggggacttccagttatctttctgttattcatttcttgtttaattccaatgtggtctgagagaaaacactgtgtgattttattcttttacatttgttaaggtgtgctttatggcccagaatgtggtccatctcggtgaatgtcccacgggagcttgagaagaacatgtactctgctgctgttggataaagtattctatagatgtcaattatattaggttgattgatggtgttggtgagttcaactatgtccttcctgattttctgcctgctggatctgttaatttctgacagaggggtattgaagtctctaactttgtcaatggactcatcaatttctccttgtcgttctaccagtttttgcctcatgtatttgaacactttgttgttaggcacttacatattgaggattgttgtgtattcttggagaattgacccctttattgttatgtaatgccttttttttttttttttttttttgagatgttgcccagggtggagtgcaatggcacgatctcggctcactgcaacctccacctcccgggttcaagcaattctcctgcctcagcctcctgagtagctgggactacagtcacccaccaccacgctcggctaattttttgtatttttagtagagacggggtttctccatattggtcaggctggtctcaaactcccgacctcaggtgatccaccctcctcggcctcccaaagggttgggattacaggcgtgaaccaccgctcccagcctgtaatgcccttttttatccatgataactttccttgctttgaagtctgctctgtctgaaattaatatagctgctgcttgctttcttttgattatctgttagcatgatatatctttctccatccacttacctttaatctacaggtgtctacatgtcaaatgggtttcctgtagacaacatataattgggtcatgttttgtgacttcctctgacaatctctgtcttttattattttatttatttatttatttattttttgagacggagtctcactctgtcacccaggctggagtgcaatggcgcaatcttcactcactgcaacctctgcctcccgtgttcaagtgattctcctgcctcagtgtcccaagtagctgggattacaggtgcctgccaccatgcctggctaatttttgtatttttagtagagacggggtttccccatgttggccaggctgctcttgaactcctgacctcaggtgatgcacccaccttggcctcccaaagtgctgggattacaggcctgagccaccatgcccagccaatctctgtcttttaattggtgtacttaaactattgacatttaatgatatttggtgctgttttctaatttttgcttttgtttctatttttgttttctgctccttttcttccttttgtggttttaattgagcatttcatatgattctattttctctcctttctcagcatatcagctatacttcttttttaataccttttttagcagatgccctagagtttgccatatacatttacaactaatccaagcccacttccaaataacactgtaccacttcccaggtagtgtgagtaccttataataacacaataatcttaatgcttccctctcatccctgcgccattgctgtcattcatttcacctgtatattaggctacataatcaaatagattgttgctattattattttgaagaaaatgttagctgttagatcaatcaggaataaggaaaataaacgtttttcttttactttcatttattccctctctgatgctctcctttccttacatatatccaagtttctaccctatgtcattgtccttctctttaaaggacttcttttaccatttcctgcaatgcaggtctactggcaacacattttctcaatatttatttgtctgagaaagtctttattctccatcactcttgaaggataacttccgggagtacagaattctaggtcggtgcagagtctctctcaacactgaaaacatttcactctgctccttccttgcttccagggtttctgagaagttggaggtaatgatttcaaaatggttccttttccctccccctgccagaagcatgaggaagttattctctgatatttactgtgagaacctggtcaagctcctggaggtaaaactcacaaaagtgtgctcaccccatcagtggccacccctgaagtttttcgctctgaaatttgtccatacctagcctccagcaattcgtcaattacagttcaggtctcccctccagcagtggttcccacggatgtttctgcccagtcgtgattctctgtatccacctgtctgtctctccaacttccagggcagtggaagtgagcttttcttataggtctaagaaaagctgttgatttttcggtttgttcagcttttcacttgttgttaccccacagctttagacattttggctttctcacagttctccatctacgtggctttcctgctcaccgccactgttcagaccgctgttgctcctcgcatctgagtttgctagacttggttccagaatgtttccttccagataatcacttatttcgaaaatggggatgatttcctgtgaaccagctactgacttatgccctatggccctgccattccaagaaaagggtcactggtttgtccctcagaagtgccagttaattgaacaactgtctgaactcttcagagacccatctgctctcagcaacctctttcagtttgggtgaataaatgtaaattaatgaaaaaagtagtaatggtgtctggcaaagcagaactcaaagaacattaaatggtatcaaaaaagtataattttatgtcaataaggagaccactttgccataaagaggtaactgtaatgaatctttatgaaccgggcagcatttattagagaaagcacaatttgctggaagtaggtgaagaagaaatgggcagaagtatgacacagtctttttcttggggcaaaaccaagagaaggaaacaagctggctaaaactatgtgtcaaactgtgtacactacagagaatgtgcgctatctagttccaaggacaaatttacaaaggaggataatatatcatgctgcaaaggaaatcagaatcaattactcaaatggccttggccactgagaaaccctctccatccagcacatatggaacagcagctgccactgccactgctacctggtcctgctctccgccttagctctgccttccttccaagcacctatcgctactgaacgttccagattctagaggtgttcactttggtcttctccgctcaaaggagcgtgccccaagaacagggctcaagccagcatctggaagtgcctggcccatcctcggcactcacatgtcagttcactgaatgaataacttccgcaaacacacttgcacctctcttgcctttgttatcggtgtcaaggaggaaatggcatctttgcggatttcttcagtgttctagccccagagtctagcatgacaggcagtgggagggttgtgagtttagatggagtgacagggaagtctcgctttgtagaaatgcacaagaaaggtgatgcatagaaaaccaagtggtgagtaaggaaagggcaaccgcttgccctttctctaggccaaggctcccaggagaaggaagctggacggagtttctgggtcacggcctggcctcggcttccctgacagttcatttctgggaaagccagtgggcaaggttgttagcgactcctgggaaacaggggtctgcagtcgtgcacctgacagggctgggatgggaaccagagactgcacacctctgtctctaagtcacactttgccgttccaggctggctgccctcaagcctgggagctggtcaggctgaaccctcctcccggggtctcctttgtgtctcctgtctgttggcactggtgtccctgtagcccttgtcgtcttgttcttgtctaccccctgagtttggcgcactgagaaagagtgtgtgggagagaaatgtttgagaacgtgcatgtctgacaaccttctgtccactgatgccgttgatgatgtggctacatgtggaattctaggttggaaatgattttcctccagcatttggagggaattgctccattagctccaggtgttgccattgcagtgtgtgtattgtgtgtgtgtgtttgcgtctgtgtgtgtgtgtgtgtgtgtgtgtgtgtgtgtgtgtgcacatacattacctgtatattataatgtttagacatcttttctaaaaactccaaaaacgaaaacaaaaaaactctttctggctggagagactgtcctcccagggccagccaattcttagagagaaggaagggccctgctgctaacaggcctttggtgtgcagactgagcagcccaggccctttcgtcctccctctgccttcatcatcccagagccaggcgccaggcaaccagggacaagccctgtgcccttaagctctttaaactgctggccttgcctttgctgtggaaaccccagtaaaggctctggcctcagtcttcctgtcgcccctgtattctgcctcccgaccccctggtgcttccccatggggcctcgtgtgccgggccgtgtctcccatgtctaggacctgtgaggatgatcgactcttttttcctgagcctgtgctgtttctcacttgactgaccgtttcattacaaaaatataagccggccattctgcttcctgcctctacactgaactctccttggaagctcgttgaaccttcctcatgtcctccgtgctctgagatgtcatggtgatgtgcctgggggaggctctgttgtcagccacacgcagggcatactgtgggccttttccatttggcagctcctgcctttcagtctgggagaacgacaagaagctctggggacatcagattccctagagaagacacttgtaacaagctgcctggagggccgggacctggttgcagagatctgggagcagagcaggggaggggacgtcgctcagtgcttgcaggcagtgccggctcacagcgtcgctctgctccgggtacaatttcactgccttcaattggacctggtgtcccacagttcactgactcctttgccctctccagagaataaagtcccccatttctgtcaggatggaggaggcacagttgcccaggggcacacgggcagagaggtttgcctgggactgagggcgttcagaggacatggggctggcagcactgaaagtggctgggacaataggttaccctagcacccggagctcagagtgcttagtaaccattagtaaccagctttcacccagtcctttttcttttcttttcttttcctttttttttttttgacagggtcttgctctgtctcccaggctgaagtgcagtggcgtaatctcagctcattacaacctccgcctcccgggttcaagcaattattgtgcctcagcctccaaagtagctgggattacaggcatgtgccaccacgcctggctaatttgtgtatttttgatagagaaggggttttgccatgttgcccaagctggtctggaactcctggggtcaagtgatccacctgcctcagcttcccaaagtgctgagattacaggtgtgagtcactgcggccaaccttcacccagtcctctttattttagtgccccctccgcccccagctccagttcctgggccctgggctccctctctgcagcttgccctctgacattcggagagctgtttgtccggctctccaaaccttgttcctgttgtgtcatcccctgcccttcccattcatgtcgagttatgcccctttttttctccccaaagctgctttactacagctttactgttcaatctgcattctcgacccagaattaacctctctgtgaatttttatattcatagcagctttatttgtagtagttctgactggaaacaactcaaacgtccttcagagggtgaatgataaattgtggtacatccatgcaaaggaatactattcagcaaccaaaaggaatatgatattcaagcaggcaactacctaaatgcatgtcaaaataattacactgaaagaggccacattgagaggatatactgtatgattatatggaactctagaacatacaaactaatctatagtgacagaaagctgatcggggttgcccggagattgggatacggggagtgttgggagggaggatttacagagatgcaggaggaagctcttagggttgatagctatgttcattaccttgattgtggtggttttaagggtgcatacctgtgtcaaaatggaccaaatggtatactttatgttatttattttttaaaattagagatgggggtctcactatgttgcccaggcttccctatgtttgttgcccaggctggtcttaaactcctgggctcaagcaatcctcctgccttagcctccggagtagctgggattacaggcgcatgccacggtgcccagcaaaattatatactttattattatcattattttagagataggtctcactctgtctcccaggctggagtacagtggcaatcatagtttaccgtaaccttgaactcctgggctcaagtgatcctcctgccttggccttccaagttgctggggccacaagtgcatgccacaatgcctggctagtttttaaattttttgtagcaactaggcttccctatgtttgttgcccaggctggtctcaaactcctggcctcaagcaatcctcctgcctcagcctcccaaagtgctgagattgcaggtgtgagccaccacacccagcctctgtatactttaagcaacacacactttgttttatgtaggctataccttgataaggctgtttgaaatagagtgcatcaaatatattgcgcagtttaaagaacaattctaaattgaacacccatgcaaccatttgcttacccctagtaatggagctattctcattttattcttaaagattcatcgttttgcccttcatatttaggttttcaatctgtgtaaaattgatttttgtaatggtgtgaagtagaggtacagcttccttccttttcctttttttacagtttctctttctttctctttttttttttttttcagacagtctcaatctgtcacctaggctggagtgcagtggcgagatctcggctcactgcaacctccacccccgggttcaagtgattctcctgcctcagcctcccaagtagctgggattacaggcgtgtgccaccacgtccagctaacttttgtatttttagtagaggcggggtttcaccatgttggccaggctggtctcgaacacctggcctcaactgatccacccgcctcagcctcccaaagtgctgggattacaggcgtgagccactgcgctggccttttcttgtttatgatctccaggggatgctttcaactttttgtcattaaatatgatgatgctataactattttaataaatcctttgctaaggaagttcattttaattcctaggctcctgacttttctttgtaatcatgaatggatattgaattttatccagtgctttttctgtgcttattgtggtgatcatgtaattggtattttttttaattttttttgagacagggtctcgctttatcacccaggctggagtgcagtggcatgatctcagctcactgcagcctcaacctcctgggctcaagcgatcctcttgcctcagctccccaagtagctgggatgacaggcatgtgccaccaccggcaatttgtgtgtgtgtgtgtgtgtgtgtgtgtgtgtgtgtgtgtgtgtctattatttgtagagatgaggtttcaccatgttaaccaggctggtctcaaactcctgagttcaagcaatctgcctgccttagcctcccaaagtgctaggcttactgacatgagccaccatgccctgctgatcatgtaatttttcttctttaacattaatttggttaattacaataaatgattttatattattaaactaactttgcactcctgagataaacacatcttggtcaccatgtattatctttttttttccttttgtttggttttttttgagacagcatctcgctctgtctcccaggctggagtgcagtggcacaatctcggctcactgcaacctccacctcctgggttcaaacgattctcctgcctgaccctcccgagtagctgggattataggtgcacgccaccaggcccagctaattttttgtatttttagtagagactggatttcgccatgttggccaggctggtcttgaactcctgacctcaggtgatccacccgcctcagcctcccaaagtgctgggattacaggcgtgagccaccgtgcccagtccagtcaccatgtattatcttttttacatattgctagtattctgtttgggatttctgaatctctgcctacaagtgaagttggcttataattttctttctcataatgtccttgacaggttttggtttcaaggttatgtttgccttctaacaagagtggagcctctttttcttaattctctgaaagagtttgtgtaaaattagaactattgcttcttgaatatttgatagatcttgctgatgaagtcatctaggcctagagtttggtttgaacggaagatattttattactaacaaaaaatttataattatatgactatttagggtctttgctttttcttgagtcaatactggtaatttctttttctaggactttgttcatttcaactgtattttcaaatgtattggcacaaagttattcacaatagccattactttaaaatcctgtctgcatctgtggttatagccattttccattcatagtatagtttccatgtgccttttctcttgtttctctcaatgaggactgtaaatgtcattagtcctgccagggaagcttctgcctctgacaggcgtcactgctttgctccctgctctaaggagtcacctgtgtgaagtttttccttttcccatcaatcatgtcgccatcctcctggcaacagtatagattggtgtctgacgtaggaatgacacaaagaccccatccaaaagtagccaaactttatttcaagcttaagaaaatgcatattttctccaaacttaagcagaacattgttatgagaaaaaaactggactttcttgcactgtatttcttttttagggggaggggggaaggggagatggagtctcgctctgtcgcccaggctggagagcagtggtgcgatcttggctcactgcaacctccgcctcctgggttcaagcagttctctgcctcagcctcccaagtagctaggattacaggcgcccaccatcacgcccggctaatttttgtatttttagtagagacagggtttcaccatgttggccaagctggtcttgaactcctgacctcatgatccacccgcctcggcctcccaaagtgctgggattacaggcgtgagccaccgcacccggcctcttgcactgtatttctgttggaagatcacaaccatgttgctcattctttcttattaagattcccatatctggtgtttcttggagatgtatctaggtcaacatgacccaggtttaacccaaacaactcataaaaacatggcagacttttagcccttgggaaatgaacttgctttggccctactgaagagactcatttaaaccctcctcttcctctgaagcctgtccctgagaactccaccttccctttctcttttcaggctgcctggctgcacttggacctacgctcatcatctctttggctgtttccattgtttagaggttcccctcaatgtccctggcctcaggatagctgccactggagcacagccctggcctgggaagtcccagcaggaccccagaggctccttgagtctcttaccttccttcccaggaggactgtcactgaggggggagccgaactttggtcacagcaattgagctgctttctaagctctcatctgtccaagtgtgatgtccactggaagtttctggtcctttggcccattttgattagttcctcttgtcttccagggtgagagaccaaaagtcctgtttctgtaaatcatggctgtgtgccagtatacaaaactgacaagaccccttaggacatttgtcttccaattttgaaaccggaagcctggatgaagtgtcctgtctcccagattgaaatcttggaaaacctgtttgtgacaccattggttatcttctctgtgcttcccgtctgtggccagaattgtgcccaagagcctgggccagagccagccgagtagccctgccctgtggacccaggggtctttttatagttaacttgtagctacagctggagaactggttctgcctgtcttctgtggtttcctggctgtgcacactactgagtcgtcaccgaaggggatcagggcttgttccgtgcctgtgttctccagggaacaggatcacaagacagctgtccccgggataatggactcttgggaagaatttggctcctggggggggtggctcgagggcacccgagacatctcaatcatggtcatgcgggtctgagtcttgtactgggagggaagcgagtgagtggtggccagctcggctgtctggcccccatgagactgacctctacttgaactccttgaggctggtccttctgctctgaataactagagaaatcccaggaaaatacatacattggattgcatggaataaggtgatgggatggcagaagaagctgtgggagccagtgtgagcttcaagcttcagcactgaatagcagctcatcctccatccacactttctgtagtgctgtgcacagtagggagcagcccctctgcctgccagtccttacctgggggttcctgagctgaccaactctgtagggacaccgtgaaactctgtagccatcaaagaccctcagtccgggcacagtcacaggggagggactcatgtcctcaggggaggcctccttgacactctccagcatgctggagggtttgatgagattcttctgctgggtggctgggcgtggtggctcatgcctgtaaaccccaaccctttgggaggctgaagtgggaggatcacttaaacccaggagtttgaggctggagtcagctataatcatgccactacactccagcctgcgtgacggagcaagaccttgtccctaaatttttttttaaattaaaaaaaaaaagacgatcctgctgggtgatggtggctttttttctgtacagctagaactagagtaaaggggaggagtttcccccaaaggatacttttgcccatttgcaaaggaaatgaatgaatgaagatgctgaggctctcccagctgatggaaccactattctgattgattggcttcaaagactcaccagagaaaaacattttaaaatgtagggccaaacctctgatactataaaagtgctggccttttaagacaaactctcaaagttagagtttccccacggtgagaatctctccacacagttggggactgggcagctaccccagctgggcactagaggcctgggccaccctcacaccctggtcagtggtagcacgggggctgccagacctcatcaaaagcttgacttttctttgacttccaggaggaggaaccctgtgaggcactgctccactccctgcatggttgaggacaggtgggagaggggaggctacaatcaggcttcaaggttattaggatgggccgggcgcggtggctcacgcctgttatcccagcactttgggaggccaaggtgcgcggatcacttgaggtcgggagttcgagaccagcccggccaacatggtgaaactgcttctctactaaaaatacaaacattagccgggcgtggtggtgagcacctgtaatcccagctactcgggaggctgaggaggctgaggcaagacaatcgcttgaacctgggaggcggagcttgcagtgagctgagatcatgccactgcactccaacctgggcaacagagagagactccgtctccaaaaaaaaaaaaagaaaaagaaaaaaggagaaacggttattaggatggtcctgggatggagagaaccagggacagtaagggcctggccagggtagggcagctgctgcaggaacagcaacccagcaactggccacacagagggcgagtgacccctgggcggactgatgggccacaccacaggccacaccacggaccacaggccacacccagagagctagtcctggggcagggagcgcctctgagcaggaaatgacagaggaagtttctggtgcagctttactgataaggaaacaaacaaagactgtgtgatagcaatcagaaaacatttcagtcaagcagagtggaaggaagactgctttatctttctgttccctctagtgagaattatgtcacaatatcattgtcagatgaagatgcgatctaacactatgcagccaaaatgtggggaaaaaagataacacaggtagcttcagtacaaaatataataggaacaaaaacattgtactttgctgccttttgttgtatttgtcagctttttaaaatttgtaatttgttgtgatttcttatctttttctaaatgaatggacacatttgcaagtgatttagtattcttaaagaggaaccctaaattatataaattttggtctctatacaatgtgggttttccttcctatatacatggtaacctgtttagaaattttaattaaattaaataagttgaagttgtggggaacaaatcatcatgttatctcttttctgtgcacaaaagtcgtttttaaatactggaatggggcggggtgtggtgcctcatgcctgtaaccccagcactttgggaagctgaggcaggtggatcatctgaggttgggagtttgagactagcctggccaacatggcaaaactgggtctctaccaaagatacaaaaattatccgggcatggtggggtgcacctgtagtcccagctactcaggaggctgaggcaagagaatcgcttgaacccgggaggcggaggttgcagtgagccgagattgcaccagtgcacccaagcctgggcaacagagaaagactctgtctcaaaataaataaataaataaataaatattgcaatgggaaaagagaaaaataaatcatagaattttgggatattacactttaacaagttaaatcaaaacatttataaatagccatataaaaccaaccatataaaaccaggctattagtaaaaatctaaatggtcgtcctgcttcctaaatgtactctttctctcaaaaagtttttggatgagagaacatggaaaactggggatttttcctccactgttacaatgtcctgcttgctcagtcacaggataagaaacaaggaaacgcatattgctatcaggcccaaattgaacagtcatgaagaagcttcaggaatctctactgtgttaaatacacttactaatattgaaagggctttatcaacacagaagatagagagagaggcagaacagcatggccaaatagaagcctccagtgatcatccccactgcgggaacaccaaattgaacaactagccacacaaaaaagcactttcctaatatccaaaaatcaggtgagcgatcacaggacctggttgaacttcacatcactgaaagaggccgtgacaagggtaggaaggacagtcttgaatcactccccgccccgcgccccagcctcagccccggcaccccccacccccagcccccgctccgcagcagcctcgtggtgcagagagagaagctgtacacttgggggagggagggcacggtgactgtggggctttgcgtcggaactcagcgctgctgccgtgtcccagcagaaagcaacacggggcagaagttagcgggcgcccacgaagggaggatttacatcagccctagccggagaggaatcgcccatcttcagcggatggagcctgagctccagcaaagcctcaccactgcggcctaaagtattcaggggcctgaaatatacttgaaaggcagtctaggcaacaaggacggcaagtcccgggcaagtcctgctgctggactgggctcggagccagcggacttggggtacaagcgacttagtgagatagcagccggggtagctcgggccatgcttacacctcccctcccccaaggccaggcagtgccgctcacagctccaggagcccctccttcctcttgcttgaggagaggacacggaaaagtggggaggacattgtcttgtgtcttggataccagctcaaccacagtaagatggggcactggtcagagtcgtgaggcccccattccaggccctagctcccagacgacatttctagacaccctcggccggaagggaagagaaggacccagtctagcgggactcatcacctgctgactgaagggctcttgggcactgaggaaccagcagccatacccaggccgtacttgctgcaggcctcggctgacactcagagccgtgcgggcccagcacactcccagctgcggtggccacaggcagagaccccttcggtttgaggaaaagggagggaagagtaaaggggactttgtctcgcagcttgggtaccagctcgaccacagcggagtagtgcaccaagtgggctcctggggtccccagttccagttccaggcctgggctcctgacctgccctagggctagaggggatcccactgccctgaagagagaggctcaggcatggcagcatattcaccacaagctgactgagggccgttggtcctcgagtgaacacgagcgatagtctggcagtactccccgtgggcctggggcagtggtggctgtggggtgagggttctctgcctgtggaaaagggaggcaagagtgggaaggcctgtgtctcgcagcttgggtgccagcttagccacagtagaatacagcaccaactagattcctaagactcccaactacaggcactggctcccaaatggcatctctgtatccgcccaggactggggggaactcgccaccctggaggggacgacactggcctggctgcctttgccacctgcaagaaccacagggttactcggcttggggtgccccctaaagcagatacagctgcagtgaccaaacacttagatcccaaaggttaaggataaagaaaggatcccaaaagcagcaagagaaaagaaacaaataacatgcaatggaggccgctgacttctcagtggaaacctgacaggccaggagagagtggcatgacatatttaaagtgctgaaggaaaaaaagcttaccctagaatagtataactggcaaaaatattcttcaaacacaaaagagaaataaagactttgccagacaaacaaaagctgatggatttcatcggtcccaaacctgtcctacaagaaatgctaatgggagcagttcaatctaaaagaaaaggatgttaatgagcaataagaaatcacttgaaggtataaaattcagtggtaatagtaagtacataaaaaacacaaaacgctataacactgtaactatggcatgttaagtcccagctacttgggaggctgaagtgggaggatcagtcaagcccaagagtttgaggctgcagtaagccatgtgtgtaccactgtgctccagcctgggtgatggaatgggattctgtctcaaaaacaaaacaaaacaaaatggggcctggcgcagtggttcacgcctgtaatcccaggactttgggaggccgagtcaggaggatcatctgaggtcaggatttcgagagcagcttgaccaacatggtgaaaccccatctctaccaaaaatacaaatattagcctggcgtggtggcaggtgcctgtaatcccaggcgcctgtaatcctgcctcccagaggctgaggcaggagaattgcttgaacccgggaggccgaggttgtagtgagccaagatcgcgtcactgcactccagcctgggtgacaagagcgagactctgtctcagaaaaaaagcaaaagaccttaatagacatttcttaaaagaaggcacagaaatgggcaacagatacatgaaaaaatgctcaacatcactaatcatcaggaagacgcacattaaaaccaccatgagataccattttactctaattagaacagctattttttaaaagacaaaagaaaacaagtgttgatgaggatgtggagaaaagggaacacttggtgttggtggaaaacaatatgaggcacaagaaatttaaaatcggccaggcacggtggctcacacctgtgatcccagcactttgggaggccaggagggaggatcacttgagcccaggagtttgagagcagcctggacaacataacaagacccgatctctacaaaaaattaaaaaaaaaaaaattaaggccgggcgcggtggctcacacctgtaatcccagcactttgggaggccgaggtgggcggatcaccttaagttggtagttcaagaccagcctgatcaacatggagaaatcccgtctctactaaaaatacaaaattagccgggcgtggtggcacatgcctgtaatcccaattactagggaggctgaggcaggagaattgcttgaacccaggggcggaggttgtggtgagccaagatcacgccatttcactccaccctgggcaacaagagtgaaactccatctcaaaaaaaaaaaaaaaaaaattaaaaaatttagccaggcgtggtggtgcacacatttagtcccaactactcaggaggctgaggtgggaggattgcttgagcccagaaggttgaggctgcatgagccgtgatagtgccactgcactccagcctgagtgacacagtgagaccctgtctcaaaaaaaaaaaaaagaaagaaaaagaaaaaagaaattaaaaatagagctaactaccatctgatctagcaatcccactgctgggtatatatccataggacatgaaatggtgtgtcaaggagatctgcaccctcatgtttattgcagcattattcacagtagccagatatggaattaacccaagtgtccatcgatggatgaatggataaagaaaatgtggtatctatacacaacggaatcccattcaaccataaaaagaatgaaatcctgtcatttgcaacaacatgaataaacctggaatacatcatgttaagtgaaattagccagacacagaaagacaaatactgtgtgatcttatatgtggaattttttttaaagagttgagggtaggtgcagtggctcacaagtgtaatcccagtgatttaggaggccaaggcaggaagatcccttgaggcctggagtttgaaaccagcctgggtaacctagagagaccctgtctctacaatatatatatacacacacacacacacacacacacacacacatatatatatatatatatatatatatatatatatatatatacatatatttttttaattagctgggcatggtggtgtgagcctgtagtcccagctactcaggaggctgaggtgggaggatcatttgagctcaggacttcaaggctgcagtgagctaggatcatgccactgccctccagcctgagtgacagagtgagaccctgtctgtatacaaaacaaaaaaggctgatatcttagaagcacagagactggagaagggagcacagggagaggttcgtcgacagtacaaaataacaattagatgggaggaataagttctggtgttctgtgcacagtgggatgatgatggttaacagtaagatattgcatattactgttaaaatagctagaagaggcctgtcatcccagcactttgggaggccgaggtgggcggatcacctgaagtcaggagttcaagaccagcctggcaaacataatgaaaccccatctctactaaaaatacaaaattagccgggtgtggtggcgggcacctgtagtcccagctactctggaggccaaggcaggagaatcgcttgaacccaggagacggaggttgcagtgagctgagatcgcaccactacactccagcctgggggcaagagagcaagactccatctcaaaaaataaaaaataaaaaataaaataaaatagctagaagagaggtatttgcatgttcgcattgtcaagaaatgatacttgcatgaggtgataggtacactaactaccgtgattgggtcattgtgcaacgtgatatgaattggcaccataaatatgcatgattacaatgtatcaagaaaaaacaaataaagccaagaaaataatctaaaactccaggtttcctcaatatttctttataagaaaaatccttgaatagattaaattgttttattcttcatttaagaaatagctgtatgtctttgtcttctctccagttttatcacagtacgaagtatgtaaaagtgacaatgggaacactgtgctttggtttttgcaagatttgagatgtatccattatgattttctcatgagaaattttattatgttgacctttctaaacccataatacttaccttgcagatcacgtacgtcagcatttcttacactaaatatctaaggttttgtaaatgtaaacacgagttgagctaaactgagttataataatgaatatctgtatttttaaaatcaaccttttaaacttccaacaatagcagtaattgtgtagccctacaaagttactccaccttgtaaacggaataaattgtagtgtcatatttgtcaaattttattcatgaagtgtgatcatattgtgctactatcatttctttttttctttttttttctttttttttttttttgagatggagtcttgctctgttgccaggctggagtgcagtggcatgatcttggccaactgtaacctccgcctcctgggttcaagcgattctcctgcctcagcctgtcgagtaggtgagattacaggcgtgcgcaccacacccagctaatttttgtatttttagtagagacagggtttcaccatgttggccaggctggtcttgaactcctgacctcgtgatccgctcacctggcctcccaaagtgctgggattacaggtgtgagccaacacgcccaggcagcctagtataatttctaagattccctcatctactgactttgatacctggggtagacaataaattgaggtaattagcaagtatatttacctggataatctccaaaggaatgaaaattcataaagacaaaatgcaaacacacacagttatttctgacatatatgtattctagtctatgcataaacacaatggtgccacacaacactcataaatcagaaaatcactgtagtctaaacattgttttgtgctatgcctgaatttttacttattttttttttagagaccgagtctcactctgtcacccaggctggagtgcactggtgcaatcctagctcactgtggcctcaaactcctgagctcaagtgatcctcccacctcagcctcccaagtagctgggatcacatgcgggtgccactacaccctgctaatttttgcatttttactttttgtagagatggggccttgctgtgttgcccagcctactctcgaacacctggcctccaagcaatcctcccatcttggcctcccaaagtgctgggattacaggcatgagcccccacgcccaacctatgcctgatttttaaatttttactataaaacctaaacttttaaagcagtaaataataccactacctgaacatctgtgtgtgtgtgtgtgtgtgtgtgtgtgtgtgtgagatggagtctcactctgttgcccaggctggagtgcagcggcgtgatctcggctccctgcaacctctgtctctcaggttcaagcagttctcctgcctcaggctcccaagtagctgggattacaggcacacaccaccatgcctggctaatttctgtatttttagtagagatggggtttcaccatgttgaccaggctggcctcaaacttctgacctcaggtgatctgtctgcctcagcctcccaaagtgctgggattataggcatgagccaccatgcctggccgtgaacatcttttactgtgactgcatataagtgtatgtttacataaacatacatagaggtgtattacatcaatgaatgttttttaaagtttctgtatgatggagtgcagaggcctgggcgcaagggagtaaagggtctttaagtaatcaatatattttcaacctcaagtatcctatctagagccagaggttttttttctcaccctactaggagctcacagcactgcaaatctgttaacagaggtgcttttatgctgccccttggcatggttatttcataactgcagccaattataagagaacaagcaatcgaacagaacaaagagcaaaggctcttcctttgtggaggagctaaaattcccactgcttaccatgttaccttctcctgtgtgttgttatcaaatattgggactctggttacactgtcaaggccatgggcctttcttgttctagggcagctgtgctcctctcttaagcaactgacccgtgtctcctggcaactctctttggtactggacttctccaagatcagtcctcaaattaataacaacactgacaagggtcttcggaccaccgtgtttggtacctggctgcttgggaccatccaggtttgcccctttgcctggcttgggtaacccactgtatggtgcacacgaataaaggctgatgccgagaagaatgaggcttgtagttacgaaaagtgactcaatggaattaaaaaatctaccctgcagcctgggagcagtggttcacacctgtaatcccagtgctttgggaggccaaggcaggagagtcgcttgaagctagagttggagaccagcctgggctatatagcgagaccctgtctctacagaaaaaatacaaaaattagctgggcatggtggtgtgtggctgtagtcccaggtacctcgagaggctgaggcaggaggatcgctggagcccaggaggtcgagactgcagtgagttgtgatcgtgccactactgcagcctgggtcacagagcaagatcctgtctcaaaacaaacaaacaaacaaacaaacaaacaaaaactatcctgtaaatgtataaaaatgtcactaatttcaatgtgtttcggtaaaaaggaatgaagtaccgatacatgctgaaattcagatagatcctcaaaagcattttgctcagtgaaagaagccacacatgaaaagtcacatatcagatgagccactttatgtgaaatatccagaatagaggaattcatagacacagacagcagattagcgggtgccaggggctgagggattaggggatggggagtggccacgtaatggacacggggtttctgtacggcatgatgaaatattctgaaagtacatagtggtgatggtggcacaacgtgcattagtaaatgcactaaatgtcactacactgtacactttcagatgactaattttatgttatgtgattttcactttaattaaaaaccaccatattggccaggcgtggtggctcacaactataatcccagcactttgggaggccaaggcaggagtatcatttgagcccaggagttcgagaccagcctggccaacatggtgaaacccccatctctacaaaaaatacacaaaaaattagccatgtatggtggcatacacctgtagtcccagctacttgggaggctgaggtggatcgcttgagaccaggaggcagaggctgcagtgattggagatcgtgccactgcactccagcgtgggtgacagagtgagactctgtctcaaacaacaacaaaaacacaaaatattttggtaatgcataacttcttgggatgaattttaaatgtttatttttttatgcaagagctaacacaagtgctctcagcacgatgactttttaccttctgaaagattgtattgtgagctttaaaatctctttgtccattaatagttttagtgactcacaaaatggagatttccagacccaagatagctagaaacaagtggcctagcaggacagggtcatggtgtacagccaagctgtaccttggtgtgaatgcaggggctagaacgcatcaacaccaaggtttatcaagtggtgacaatgtggacaccaatacttggaaagtggcagcgccactgtcatagacccccactttcccatcagagatcccagtgccaaggctgtaccaacttctttctgttccttgggttttctctttttttctttcttttttttggggagacagggtctcgcttttgtcacccaggctggagtgcaatggcacgaactcagctcagtgcaacctctgcctcccaggttgaagtgattctcctgcctcatcctccagagtagctgggattacaggcacccaccaccacacccggctaatttttgtatttttagtagagacggggtttcaccatgttggccaggctggtctcgaacacttgacctcaggtgatccacccacctcggcctcccaaagtgctgggattacaggcgtgagccacagtgcccagcctagggttttctcttaaacatgggaatggatggaacacctctcactggatgaggtagattgtttccaaagatggctgctcccatggctcccattctgcatgtccttctatagcattacttggcactccgcccaacaagaggcggaggctttttccccttctctggaatcagagctggccttgtgacttgttttgactactaggatgtggcagatggaacattaggtgacttccaggcctaggccataacaggcattgcagtttctgtcgttgccctcttggaagccagcaccataggaagaagtctgggctatcctgcttgagaggccgcatggagagagaggccctgcaggatgagatgccatgtggaggagagtaatacaagccagctaacagccagcaccaactgccagacatggcatgagtgaccccaaccaacacgaggtggagcagaagaactgtgccttacagatcagtcgatacataaactcataagaactcatcaattgttattttatgccactaaattttgggggggcttgttaggcagctctacacttgagatccagaccaaatggagagagtatggtaagctctggggagcaggtcgcaacctgaaaagcctggcagactcgactcatggaggaagactgctggcccctacttattcccccagcagaataagtaataattacaaaggatttgcagggaacaagggaaatggatgaggaagagacagttcttgttctctatctgtccaggaatattttttggcatcatccttagtgtactatttctaatagtcatacaatgacgtcttgtcctcttgccctttctctatttctccatttaacaggttaggtctgtgcaggctggatagtgcagctgggacatctaggaccacattagatcctagatgcctccaaggcaagagatagtatcacaatgtaaaaaatgcttgtataggctgggcgaggtggctcacgcctgtaatcccagcactttgggaggctgaggcgagcagatcacttgaggtcaggagttcgagaccagcctggccaacatgacaaaaccccgtctctactaaaaatacaaaaattagctgggcatggtggtgcttgcctgtagtccagctactcgggagactgaggcaggagaatggcttgaacccaggaggtggaggttgcagtgagctgagatcacaccactgcactccagcctgggggacagagtgaagctccatctcaaaaaaaaaagaaaagaaaagaaaaacaaaagaaaatgcttgtatagcaaataggttacgctttagaaaaccacagctatctttgatagaggagtatgggttgagatcatattcatcttgacttttattcgttcaaatgattacatcaatgactaacctcaagtgagtttatgactgggcagggaatgtgaccaacatctaaagtctgtgccatgccactgcccacgggctgcttggcttcagaacaaagcggttatttgcatcagtgaatccaagttggtcctcttgcctcccatgctataattggaaacaccgagtttgtaagtacaatgtcaccagaaatgtcacttgtaaatgcaaagctcaaatcatcagatccaagactctaagacacccagccttgcagaacaaggatggaacttgagaggggagagaatgtgctagagcttacactgatgacctggagggtcacagccttacccagatgtacaggggctgccgtcagagtggggacaagttttctgttcaaaggcagtagaaagctttttagaacaatggaagcaaataatatctcttgttgcattgtgtacaaaatgtgagacagatcaatggaatacacacaataacagataaaggaaatacacaggaaatgcgtgcaagaaaaacacctgggtccctgaatgacaggaaatagtgctgtctaatagtgcactaagattctgttagaaatttcttccctagcaatgaaagacagttaaagggaatcatgtcattgtatgtgcaaatcttggtattttaattgcatatgtatcgtataaattaagcttttgtctgatttccactgtctgtaagagttaaaattaaaaaaataaacacttggctggaccacacactgaattaatgattttaacacaaaaatgatactgaagagaatgtgaatgcactaatgccaccgaactgtgtgtacttaaaaacggttaagatggtaagttgtatgttatgggtattttaccactattaaaaaaaagtttttaagaaaaaaggctaataagatttctgggttcaggcaggagtaggaaggcagcgaaaacccgaattcccccacttctcctaaaagaagtccaaacacaggaagaatgaatgagcccccctccttgatatactggaggaaaccagaacctgtgccatcagaaagcgctaggatgtgacaaagcagggaggggactacaaagggccccagcggtcccgaccaggatccaccctttcaggacatggcccaggcccgctcaggatcgcatgggggcagatgcgagccccaggagaactcccgaggacccgcggcggccgccgggggcttcctgacgcgcgagcggcgaggcggcgccagaagagggcgcccgggagccgaacaggaggccaaaccccgggccttcccgcgttcccgggggtccccgtgctaaggcagacagaaggcgcccacctgtcaacagtgagaaccagaatccacaaaggccaaagtgcggaaggcactgagacaaagcaaagcgacccacagagcaagaggaccgagccgccgccgccgctcaccggaaaaagcgttgcacagggcccgaggcaggggcttcgcagaggcgttcagctcaccgctgggagctgttctggggctccgggtcccacggccgtttgcccagccgtttccgaagccgcagccttgctccggattcgcctcgcactttttttttttttggacagtgctaggaaacatgcgtttaataaagaaatctaggcatgcagttttcaattaacatggcccattatgtctctctccttccgcttacagtgaagatcaggaccatgaagtgaatttgaatttcttttctttttttcttttcttttcttttcttttcaagacagggtcttgctgtatggcccaggctggaggatcatggctcactgcagcctccacctcctggcctccagcaatcctcctgcctcagcctcctgagtagctgggaccacaggtgtgcaccaccacgcccagctaagtttttaaatttttggtagagatggggtgtcactatgttacccaggctggtctccaatacctgggctcaatcgattctcccactttagcctcccaaagtgctgggattacagtcgtgagccattgggcccagtcacaaattccttattttctttgtcctacgatatgaacaacccagttggaacataatacgacgtgagaagagaagcctgccatggggaggggagcacagacccagcaggcaggctctcaatgggaggttcaaggcgagtccccctcccacccacctgctcccagctgagagtccatctgggcctccggtgggcaacgacaaaaaattccattaggttgagaagacgtgactggcactggctcaaagccaaacaaatacttggtgggcctgcttggagtttagctcacactttttgattttctattcactgaatttcactgctgtaggaacctcatataaatggaatcagatagttatttttttttatgacaggctttgggggatatatctttttgaaggctctttataactaaacagtaaatagtttaattacagtggaaattctctggactagattgtaaaggtggatcagatttggaaataagacttttttcaagtcaaagaagaaaaaccaatttaaaaatacaaggcaatggccgggtgcggtggctcacgcctgtaatcccagcaccttgggaggccaaggcaggtggatcagctgaggtcaggaattcgagaccagcctagccatcatggtgaaaccctgtctctactaaaaatacaaagaaaaaattagccgggcatggtggtgcatgcctgtagtcccagctactcaggacactgaggctgaggagaattgcttgaacccgggaggcagaggttgtagtgagcaaagatcgcgccactgcactccagcctgggcaacagagtgagactccacgtcaaaaaaaaaaaaaaaaaagacatgtcagaaacaaagaaagaaagacatgacaggctcagaatcaatgtcaacctgggcaaaggtcagaaacggaacagggaccctttctttgtgggcaggtttgacatgaaaggttcagcgacttcaactcttctgattctttcttcttgagcccattttggtaagttgtgttttcctaaaagtttgtccattccatccaaatgttcacattagtcaggatctgtgaaggatgtcaatggctgtgaggcgagggccccttgccagtccccatgttcgttatttatggatgcctgatgcccacaacctcgacttctcagctgagggcaactcctcctgtcctctcgctgcttccacctaagccaccaggaaatcctgttgactccacttacaaaagctctccagagtctgctacctcttaccaccctactgtcgcctcccagacctggtctccccgcttctgccctggcccctacagctcgcagacagctgccagaggagtccatccgaatcaacttcagattgcgtcactttttctttcaaaatccgacaaagctcctcattccattcagagtgagaagggccccgccatgcagcctttcctcctcctattcaccaaccccactctcgctccagccatcttgatatccttgctggtcctggagcaggccagccacgctcttgccccagggcctttgcacttgctgcccctctcctgtgatgccctcctggatctctgcatggctccctcctgccctccctccctcgagtctttgctcacatgtccccttctcagaggggctcaccctggtgcccttcgaaagtgggcatccactcccttcccaccctggcacccgcaccctcctgtcttcctttttctgttctccatcctactcatctcccccaactagaaaggcagctgcagctgcggagcacgggatctccatctgcagctgcatcccgggacctagaacaggtacaaaagtacctaataagtacccactgaatgaataattggctgagttttctgtaccaaagactgagctaagactctttaaaaggatgatcttatttaagccttacagcaagtaaatgttatccccatcttcctgatgaggacacagtgaccaccacgctcaaggacacagagggtggacgtgccacattcacactctgtgacttagagcggctggacgggcagggacttaggaggcctacagcagccagggtgagattatgaggctgagctgagaatatcaagactgtaccgagtagggggccttggcaagtgtggagagcccggcagctggggcagagggcggagtacggtgtgcgtttacggacctcttcaaacgaggtaggaaggtcagaagtcaaaaagggaacaaatgatgtttaaccacacaaaaatgaaaatccaatggttggatatccattccaaatacacaaaggcaacggataagtgatccgggccaggcacagaaggccatgcacccgtaggattgcactcagagctcccaaatgcataggaatagaagggtgggtgcaggaggctgaggggtggggaaagggcatgggtgtttcatgaggacagagcttccgtttcatgcaatgaaaagagtttggagacggatggtggtgactggactatacacttacacacggtagcgatggtacactttgtattatgtatattttaccacgatctttttaaagtgtcaaaggcaaatggccaaatggttccttgtcctatagctgtagcagccatcggctgttagtgacaaagcccctgagtcaagatgacagcagcccccataactcctaatcggctctcccgcgtggagtcatttaggagtagtcgcattagagacaagtccaacatctaatcttccaccctggccagggccccagctggcagcgagggtgggagactccgggcagagcagagggcgctgacattggggcccggcctggcttgggtccctctggcctttccccaggggccctctttccttggggctttcttgggccgccactgctcccgctcctctccccccatcccaccccctcaccccctcgttcttcatatccttctctagtgctccctccactttcatccacccttctgcaagagtgtgggaccacaaatgagttttcacctggcctggggacacacgtgcccccacaggtgctgagtgactttctaggacagtaatctgctttaggctaaaatgggacttgatcttctgttagccctaatcatcaattagcagagccggtgaaggtgcagaacctaccgcctttccaggcctcctcccacctctgccacctccactctccttcctgggatgtgggggctggcacacgtgtggcccagggcattggtgggattgcactgagctgggtcattagcgtaatcctggacaagggcagacagggcgagcggagggccagctccggggctcaggcaaggctgggggcttcccccagacaccccactcctcctctgctggacccccacttcatagggcacttcgtgttctcaaagggcttccaaatagcatggtggccttggatgcccagggaagcctcagagttgcttatctccctctagacagaaggggaatctcggtcaagagggagaggtcgccctgttcaaggccacccagccagctcatggcggtaatgggacaaggctggccagccatcccaccctcagaagggacccggtggggcaggtgatctcagaggaggctcacttctgggtctcacattcttggatcctcggatcctctgactctggtggggacaggcagaccaagctctcttggacccgggaagagggacccttggaagtcacttgggattgagttctagagtcttgacactgtttcagcagatctatactttgaacccacctcaggcatctcatccacagaacagggacagtgaccattccatcttgccaaggagtgcggggcacacaccatgctgctggcagccagggtggaaagtcaaggggtcccagctgaagcactgccacagaggcaggatgcagtccgagaggggacttcagagcaggggcccaaggccaaggccatcagggaggtctttctgcaggagggacctctttaggagttaggccctaaaaacaaataagaggaagaaaggcacttggtggtttttagtctattcacggtgctgtgcagccatcaccaccatccagccgcagaacttgttcatcttcccaaactgaagctctggccccgttcaaccccaactccccaccccccagcccctggcacccacccttccactgtctgtctctatggatttgaccactctaggcccttcatataagtggaattttacagtatttaccctcctgtgactggctcatttcactgagcaatgtcctcaagggtcatccatgttggagcatgtgtcaaacttcatttctttttaagggtgaatcatattccatcgtctgtatagaccacaatttgtgtagctaatcatccgttgatgtttgttgatttgtttgtttgttttgagacagtcttgccatcagagctcactgcaggctcaacctcccaggctcaagaaatcctcccgcctctctacctcccaagtagctgtgactacaggcacctgcgactgtgccctgctaatttttgtattttttgtagagacagggtctcactatgttgcccaggctagtctcgaactcctgggctcaagtgatcctctcacctcggcctcccaaagaactgggattacaggcatgagctaccatgtccagcccaattgcccattgatgggcacgggttgcttccatgtttcagctgttgtgaatcacgctgctgtgaacatgcgtgtgcaaacagcccttccagaccctgccttccattcctctgggcctatacccagcagtgcggttgctgggtcctatgggaattctacgtttaacttttggaggagctgccaaactgttttccacagtggctgcgccatcacaatccaattttaggacatttttatcacccataaagcactccctgtacccattaagaagtcatcctccatttccctccctcccctgtcctggcacccattcctctgctttgtgtgtctctggattgccctatctaagcatttcacagagatggagccatgcgctccgtggtcttttgtgtctggcttcgctcactgagcatgctgttctccaggtccatccacgttgtagcgtaggtcagcccttcattccctgttatggccaaatgatactccattgtacagacaggccactttttacccactcatctgcttctggacttttgggttgcttctaccatgtggcctgttgggaacagtgctctgtttgtattcatgtacgggtttttgtgtggacacacattttcaagtctcttgggtacacaggtgtagaagtgccagagttggggaaaaagctcacctttctaggctgtgaatgggccctggcaagtctgtggccaggactcgtcttctcttccacatggggcccctagcttggcacctagcacgtggcaggcagcgacagatgttaaaagccattcttgctatgggtagccaggctggggctccatgcagccctggccttcagcttggcagccagggcccccttgtgcctgcagcagaagccatgctgccaggagtgtaagtgtgagccaggaatgctggagaatcgtggctctgagaacagggacaagaggccacaagctcacgccttggctttcctaagcttaaggaataaacccaaaaggaggtacctggaaggagctggatttggggactgaggagctgggagctgatggaagccgtgaaaggggatgtgctcctggggaggcgctggggcgggtgggccgtggaggggacagggcccgttggttggaaactgaggcgaggctacggagttgggcactaacaggtcatccgtgcccctgcgaagcgtggggacacagggacagcagagatggcctgtctggacactctgtcgacggggggcctgtggttggtgaagcccaaggcaaggctgtgaactcagggcaagggagacgtgagcaggcgctgccgtgggctgatgtgggcactgcatgtgcaccctggcggccaaaggacctacagctcatggggggcaagggggaggagggaagccaacagcaggatgtgcgcagtcagtctgccccccctacactggaggaggagccccccggcacaaatctcgcccgtttgggcccacggacatggctggcctcgcaaggaggatccggttccaggcctcggccctaaatagtctccctgggctttcaagagaaccacatgagaaaggaggattcgggctctgagcagtttcaccacccaccccccagtctgcaaatcctgacccgtgggtccacctgccccaaaggcggacgcaggacagtagaagggaacagagaacacataaacacagagagggccacagcggctcccacagtcaccgccaccttcctggcggggatgggtggggcgtctgagtttggttcccagcaaatccctctgagccgcccttgcgggctcgcctcaggagcaggggagcaagaggtgggaggaggaggtctaagtcccaggcccaattaagagatcaggtagtgtagggtttgggagcttttaaggtgaagaggcccgggctgatcccacaggccagtataaagcgccgtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaagaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggtaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagttgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccagatactcgagaggctgaggcaggaggatcgcttgagcccaggaggatcgcttgagcccaggagttccacgttgcagtgagctatgattgtgccactgtactccagcctgggtgccagagccaggctctatctctatttggtgttgttgttgttgctgttgttgtttttgagacggagtcttgttctgtcaccccggctggagtgcagtggcgtgatctcagctcaccgcaacctctgcctcctgggttcaagtgattctcccgcctcagcctcctgagtagctgggactacaggcgcccaccaccatacctagctaatttttttttcttttgtatttttagtagagacggggtttcaccatggccaggctggttttgaactcctgacctcaagtgatccaccccctcggcctcccaaagtgctgggattacaggcgtgagccaccgctcccagccgactgtatctctaaatatataataatcataatcataatcaggacagccgtcatattggattagggcccaccctaatgacctcatttaaacttggtcatttctgtaaagaccctatctccgaaaacggtcacattctgaggtattggggttaggactccaacatatgaatttgggtggggacacaattcaactcataacacattcattgattaatttcctcattcatttattttctgagcatctattgtgtgctggacactctgtgaggatgaatgagtcaaagtctctggtgagaaagacaagacttgtacttgtgtctcagtactggctgctataagaaattaccaggctgtggccgggcgcagtggctcacgcctgtaatcccagcactttgggaggccgaggcaggcggatcacgaggtcaggagattgagatcatcctagctaacatggtgaagccccgtctctactaaaaatagaaaaaattagccaggcgtggtggcgggcgcctgtagtcccagctactcaggaggctgaagcgggagaatggcgtgaacctgggaggcggagcttgcagtgagccgagatcgtgccactgcactccagcctgggtgacagagcaagactccgtctcaaaaaaaaagaaaaaaaaaagaaaagaaaaataaattaccaggctgtgcatggtggctcatgcctgcaatcccagtactttgggaggacaaggcaggaggatctcttgaggtcaggagtttgagaccagcctggtcaacatggtgaaaccccatgtctactaaaagcacaaaaattagctgggtgtggtggtgggtgcctgtaaatcccagctactactccggagctgaggcaggagaattgcttgaacccaggaggcggaggttgcagtgacccgagatcacatcactgcactccagcctgggtgacagagcaagactttgtcccaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtggtaagccagtcggggcccaggctcggcggaaaccactcattcaccctgcaagctcctccagccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgccccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgcccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccagctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccagctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggacgacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattcacctgttcttccatcaatgcttgccttgggagcaaaagagaaagtgagattccttcagtacctcatccagagctcatgccaacagcgagcggtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatgtccagaataggcaaatccatagagacagaaagcagattagtgggtgccaggggctgggggtgggggatgggcagtggctgctaatgagtacagggttgctttggggctggtgaaaatattgtaggaccgggcacggtggctcacgcctgtaatcccagcactttgggaggccaaggcgggcggatcatgaggtcaggagatcgagaccatcctggctgacacggtgaaaccccgtctgtactaaaaatacaaaaaaaattagccgggcgtggtggcggacgcctgtagtcccagctactcgggaggcggaggcaggagaatggcgtgaacccgggaggcggagcttgcggtgagcagagttcacaccactgcactccagcctgggcgacagagcgagactccgtctcaaaaaaaaaaaaaagagaatattgtggaattagatagtggtgatggttgaacaactctgtgactatacgaaaaaccagtgaattgtacactttaaattggtgaattttatgggatgtgaattatatctcaatagagccgttatttaaacaaaaagagaaaagtgaatcatggcaatagttgcgcaactcagtaaatttactaaaaaccattgaaatgtagttaaaatggtgcattttataatatgtaaattatatctcaatagagctgttaaaaaaccacaagcaggccaggcgcagtggttcacagttgcaatcccagcgctttgggaggccaaggcaaggggattgtttgaggccaggaggaattcaacaccagcctgggcaacacagtgagaccctgtctctacaaaaaaaatttttaattatctgggtgtggtggcacgcgcctgtagtctcagctactctggaggctgaggcaggaggacctcttgagtccgggagttcgaggctgcagtgagctgccatcacgccactgcactccagcctgggcagcagagtgagaccctatctctaaaagaaaacaatcactacctgttgtgtatataattatataagtagtaaaagtataaaaccatgcatggaaaagataagcacccaaatgagaatggtgaggccagtatagcaaggccagaatagcaaggaagggagatggtgctggaaaggggtaatgagggcttcaacagaatattttaaagttttatttcctaaaaaaataagatttgaagtgaatatggcaaatgttaagatttcagaaagctggggctgttaattatgttatccttacattttccctttgcttgaaatacttcataatttaaaaacttctatgaagttccccttttggcaccacaaagaacgggccagaaggacagaggccagggggccagtgagggggctctggcaccaccgcttacgtagaagagagaaggcaccagagcgtgatggaacccatagactggcagggctgccgccccaggaggcccaggagggtggcggcaggcctcaggtgcaggaggtctaaacggtggtgctgacagagacggggaaaacagtgacgacttctattcggtcccactccaaggacttgaccaacacccacacggagaaatcccccgggcactgaataagctgacagctcatttgttgaaagccaatttgtcaaaagctggttcctcgcagcatttcaaggaatattccatttgtctctgccccaggtccctgttaagaagagagtcggtggacaacatggactaggccactgctcacagagagggggagtgggtcggcaggatggtcaccccgaaaatagattcctcattactgtctttccatttacatgaatgatctagctgtgagaacattcaagattttaactgtcctcaggaatatgaagtcaatcttcatcaatgtattggtaaagatacatgaagatattcttcagtgcattcttgaagagtctcttcagatgtcagtaaacaatattttcataaggatattctctcagtctccccttctctctggcccccatctcctggccctctggcagccgcgctcccttctcttccttggtcaaggacccccctctctccacctcctacagtcacagaagcaaatggacaactctggagaatgctcttatgaacacaaaacgatgaccagtcaacccagacaccctcaagacagaccgaaggtgttaagaccaccctctccaacacaaagtgttctaaactttattgtttttttcaaaatagtgttgttgttttttttttttgagacggatctccttctatttgcccaggctggagtgcagtggcacgatcttggcttgctgcaacctccgcctcccgggttcaagtgattttcctgcctcggcctcctgagtagctgggactacaggtatgcgccatcatgccgggctaattttttgtatttttagtagagacagggtttcaccatgttggccaggctggtctccaactcctgacctcaggtgacccgcctgcctcggcctcccaaagtgctgggattacaggtgtgagccattgggcccagccagaaagagtatattcttggtcatttctgagaatttgcttttggcaaattgagctagagcctaatcatggcccacaacttggaggaaaagtctgagacggagaaacagctgtaggaggggtcaatagcccaggtgcaatcggtgcatgtggccaggatggatgagctcactctgagcaaatgtgccaaagcaaggggccctggggagctgggggaagagccaacaaaacagaagcgaaagcaggaggaaattcgccaggacggctcacacaggaacccagaggatgtagggatacagtggaaaggttgaacatacatgtaactggggccttagaaggggaaaaatgagagactagggcagagtcactatttgaaaatataatggctgaaaacgtccaaaactgacaaaagacatcaagccataaacccaagtagcaatgcgaagcccaagcaggatgaatgcaaagaaaatcacaccaaggggagagtcagcggcacaaaaaagaagagagaaagaaaatcacgccaaacatcatcatagcaaaaccactaaacaacaaagaaaaacaaaagatcttaaaaggagcctgaggaaaacaaaactgtgatccgaggagcaacaagaagactggcagctgccttttcaacagaaaccatggaagtcagaagggaatgatttgttcaaaatgcttattatttccaaaaattaagtgccaacttagaattctatgtccagcaaaaaatatccttcagggccgggtgtggtggctcacgcctgtaatcccagcactttgggaggccgaggcaggcagatcacgaggtcaggagttcaagaccagcctggccaacatggtgaaaccccgtctctactaaaaatacaaaaactagccgggcgtggtggcacatgcctgtaatcccagctactgaggaggctgaggcaggggaatcgcttgaacctgggaggcagaggttgcagcgagccgagatctcaccattgcactccaacctgggtgacagggtgaggctctgtctcacaaaaaaaaaaaaaagaattccttcagaaataaaaaggaatgatggcatgtgtgaggcaataaggtgacagtgactgcatatttaacattgtggacttgttttaaaacatttttggtatggtatttaggctatgttaacaaaatgatccatatttcaggttcacactgaaatatttacagatgaactgatataatgtctgtgctttgcttcaacgcaatagggatgagaggaaccagttcagagagcagatcagaccttaggtcagacctcctcagagatcccaagatgcaggatgctgtgacatggaggagaagtcggggaaaaaatggaagttaacacgaccccagcctgcaacaaagccctaagcagataccttgaggaaagtcagcccgaggctggatccctggggctgagaggtcacagagcaacactgaagcctctaggaaccatagcctgttatctccaagcctcgtctgaaagcgaaacataccagaacagtcttgggacagaggagctagggtctggatgcccccaaggacctcgtgtccaggagggaaagaaaaacatggagacctggcatattcacttccgggcgttttcaatatgacaggaggctataagaaaatttcacgactgcccacttgtggatacagccagaaatacaaagcaagagtgaaagttttgcctactcggcacctgagtagcttcttttttattcaatttttattgaggtaaatttcatgtaacataaaatgaattattttaaggtgaacaattcagcggcatttagcacatgtggtgttgtgcaaccaccatggctattaatagttccaagacattggccggctgcagtcatgcctgtaatcccagcactttgggaggccgaggcgggcggatcacgaggtcaggagatcgagaccatcctggccaacatggtgaaaccccgtctctactaaaatatgcaaaaattagctgggcgtggtggtgcatgcctgtaatctcagctactcaggaggctgagacaggagaatcacttgaatccgggacgcagaggttgcagtgagctgagatcaagccactgcactccctccagcctgggcagcagagcaagacaccacctcaaaaaaaaaaaaaagccattaacaactttctttctttctttctttctttctttctttctttctttctctttttctttctctctctctctctctctctctctctctctctctccctctctctctctctctctctctctctctcctctctctctctctcctctctctctctctctctttctgtttttttttttgagacaagttctcactctgtcctctatcacccaggctggagcacagtggcacaatcatagttcactgcaacataaaactctcgggctcaagcgatcctcctgtctcagcctcccatgtagcagggactacaggcatgtgccaccaagtccggttaacacttttaaaattttttgcagagatatggtctcactttgttacccaagctggtctcagactcctgggctgaagcaatcctcctgcctcgacctcccaaagcactgggattacagccataagccaccacatctggccccatttttctttacgatctttcaaggacttagtttgcacataggaagcagaaaggaattgtaaattcagttccatcagcatctacttggggcttacacacaagtattaattaattctcacaacagttccaacaatagtgggatcatttttacctccatgttacagatgtggaaactgaggattgcaaacttgaagcacctcgtccaaggtcattcagtaaataccttgcagagaggaggctgggccaggcctaaatccagaatcagccctcctggccctgccctgatgttcccaagacacagcagatagagttctgacatacatggaggagggaggcagcccagagggcgagctgggtcccttcaggaagggaggaaaagcagcatccagactgatccatgaaacaggtactcacagaacagccatcatgtgccaacatgtctttgggcagtcactcagacacagtggccgacctgaatgtgctgatattttgacgagaacaatacaacacaaatgaatacctacacaagggagagcagtttaggcggtgagtgctgcgagaaaggaaaaagtaggggagtgacaaagactggtccggagtatataaagagctctgacaactcaacaataaaaagacaatccaagttgaaaacaagccaaagacttattggctgataagcacatgaaaaggggttcagcatcattaatcgtcagaggcagggtcacacacccactagtctcatgggctaggatactggttctcaaccaggggcaatttgccggcccccccctccccaaacaagggacatttggcaatctctggacagacatttctggttgttacaaataggtggggcacggtaggctaaaattgcccccctaggctgggcacggtggctcacatctgtaaccccagcactttgtgaggctgtggtgggcagattacctgggctcaggagttcaagaacaccctgagcaacagggtgaaaccccgtctctatgaaaaatacaaaaaaattagctgggtgtggtggcacgcgcttgtagtcccagctacttgggaggctgaggcaggagaattgcttgaacccaggaggcggaggttgcagtgagccaagatcgtgccactgcactccagcctgggtgacagagagagactctgtctaaaaaagaaaaaaacaaaaagcccctccgcaaaagatatctgtgtcataatccttggaaactgtgaatgttaccttctatgaccaaaaaagggggctttccagaagtggtgagtttaagggtattgagatgcaaagattatcctagattatcctggtggccctaaatgcaatcacatgtatgagagagaggcagaaggacattagacacacacagacgagaatgtcatgtgaagacagaacacaggtttgaagatgctggccttcaggacaggaatgatgtggccacaaaattaaggaatttggcagccaccagaaactggaagaggcaaagatcagtttgtcccctagagcctccaatgagtgtgtgtcctcctcgcctgatttcagcccagtgaaacggatttcggccttctagcctccaggactgcgagagaataactttctattattttaagccatgaagttgggggcaatttgtcacggcagcatcaattaattcacggcaccactggcatcaagtaagtggagaccagggatgctgctcatcatcctagaatgtacaggacagccccgcacaacagagaatcattcggtccaaaatgtcgacagtgccaaggtcgagagaacatgggctagggtgatgaaattttggagtctaatttcaccaagttgtggctgaacttaagaggctgacatttaaaagactgatcttgccaaacgttggcaactggaactcttatacactcctagcgggactgtaaaatggtatagccatgtcggaaaacagttcctcttttttttttttttgagatggagtttcactcgttgcccaggctggagtgcaatggcacgatctcggctcaccgcaacctccgcctcctgagttcaagcgattctcctgcgtcagcctcccgagtagctgggattacaggcatgtgccaccacgccgggctaattttgtatttttagtagagacagggtttactccatgttgttcaggctggtctcgaactcccgacctcaggtgatccgcctgcctcagcctcccaaagtgctgggattacaggggtgagccaccgcgcccggccttcctctttcttaaaaagttaagcatactgctatggggtacatgtcccccccaaaactcgtgttgaaatttaatggccatgtgatggtgttaaggggtgggactggtaagaggcgattaatattaatattgttatcatgaaagtttggcccccgctcgctctctcacgccctcttgcccttctgccttccgccataggatgatgccgtacaaaggtcctcaccagctgccagcgccttgacattgaacttcctttctttataaaccacccagcctgcggtactctgttacagcaacagaaagtgggactaagacacataacacttccctgttatctagcaattccatatatgaaagcatatgttcacagaaagacttgtgcgagaacgttcatagcagctttattcagtcgccccaactggcagcggaccagggcataagcaacctgcggcgtctccatgcaatggaaggctgccaagcaatacgaagccatgagctactcacttcacacagcttgggtggatctcaaaacaattccacggagcgaaagccgccagacacaaagcactgcgtgccgtgcgattccacttacgtgaagttcaaaaggagatgaagctagagtgacagaaaccggaacagtggccaattatgggagacgggcattcactggaagagggtatgagggtactttctggggtggtggcaaagctctttattgggattttagctgcccaggtgtaaacctttgtcaaaactcgttaaactgtatgcctaaacttaaatgcaatttcactgcataaaatttacctcaaaaaggccaggcgcggtggctcactcctgtaatcccagcactttgggaggccgaggcaggtggatcgcctgaggacaggagttcgagaccagcctgaccaacatggagaaaccccatctctactaaaattacaaaattagccaggcgtggtggtgcctgcctgtaatcccagctactcgggaggctgacgcaggagaatcgcttgaactcaggaggcggaggttgcagtgagccgagattgcgccattgcactccggtctgggcaacaagagcaaaactccatctaaaaaaaacaaaaaaacaaaaactttacttcaaaaaaccccgcttccaaaagaataaaagaagaggccatttgaacgtggtagcctgggaagtccctttgaggagaggacatcagagcagagcctaaaggacaagctgagtgtgggagtttcctctggctgccatcacaaagcgttacaaactttgagtggctttcccagcagagatggcctctctcctggctgggggtccagcagtccgagaggaaggcccaggctgggcgggctcctgccgaggaccgagaaggcgcctccactcggggcctctgtcccagcttctgctctgctgcccacctgcgggcttccttggcttctgccacggcaggtcggcctcagcctctgtctccacacggcgctctccctctgggtgtgtccgtgtctccgtctcccctttctgtcaggacacaggtcacactgcattagggcccacccctctgcagaatgacctcatccagatctaactcatcacgtccgcaacgaccctgtttccaaataagccggttccttgtcaccaagtggagccttcaatgagttgatgccaaggcaggtctagggaactagaaatggggcaagaagcaatgtcctccagccaggtgtggtggctcacacctgtaactccagcactttgggaggccgaggcgggtggatcgcttcaggtcaggagttcgagacccctggtcaacatggcgaaaccccatctctactgaaaaatacaaaaagtagccaggcatgctggcgtgtgcctgtaatcccagctactcgggaggctgaggcaggagaatcgcttgaaccggggaggtggaggttgcagtgggccgagatcgtgccactgcactccagcctgggggacagagtgagactccatctcataaaaaagacaaaaaaaagaagcaatgtgctcctcacagtcgggttttctcccaggaccattttactcatccaacaaagaacaaagatgtcccagcaacccatctaccccaggcattgaccactcgggctacaaaggtgaaggaggagggtggggctgggcaggctgggactggctatggaccccagagagtaaagatggttttgctggcaccatacccccaactccaggacttgtccatgccctgtctacggggccaagactgaaacctgactgcctttcaccatcaagcagaagtcagctgcgcatcctgtaagagatggggaaggacccccaagaccctcccagagccccctggctcattaggaggctagagggggcctcctgcaactctgcatgcaaggtgcccagatgagacctggccagtcgagacttttacttgaaggctccccatgccttccttgggtgccatctcttctaccaatgaacgttttctgagtttctcaagccttctttcctcctgacccacgaagaaactgagggaccggggccttctggtcccccaggagactggcttgtgctgaggaggtcggccgctcactgtgcatcttctcggagatctgaagctcctcctatttccacaagaaagaaagggaagcttggcaaagacccttccatccagaatcatcaagttcgcgacgcccgtgcttctcctcagcacacagagaggagagttaccaggggcctcaagcaactccagcggaagcagtcacagtccttccaggacccaggaacgtcctctgcaaggacctacaaacccagacctcatgaaggaggagaccccagggccagccccaagcctcctgagtctaattgttgctgtgatagagaccctgcacttcgcagaatcaaaaagaatatattgtgggttttttgtttttaccacaatcaattaaaaaatgcattaaaaagtaagaactgtccaggcacagtggctcacatctgtaaccccagtacttggggaggccgtggccaggtgttcaagaccagcctgggcaacatagcaagatcccatctctacaaataataataatttttaaaaagttagccaggcatggtggcacatgctttgtactcccagctactcgggaggctgaggcaggaagatcgcttgagcccaggagttcaaggctgtagtgaactatgactgcatgcagcctgggcaacagagaccctgaagaaaaagaaagaaagaaagagagatagagagagagagagagagacagagagaaaggaagaaagagaaagagagaaagaaaaagaaagaaagagagagagagagatggaaagaaagagagaaaaagaaaaagaagaaagaaagaaagaaagaaagaaagaaagaacttttgcctatccaaagactcaggaaaaataaaaaagaaagccagccctcataatgagataccacttcacagttacatctgttggaaaaaaaaaaaaaggataacaacaaatgttggcaaggatgtgaggcaactggaagccttctgcattgctggtgggaagatggagctgcgcggctgctgtgggaagactcctctaaacgctacacctggagtcaccacggggtccagcaattctactcctgattatagaccccaaagaattgaaaactggtgttcaaacaactggcatgtatctgagtgttcagcgcagggcttctcacaatagccaaaaggtggaaacaactcaaatctccatccgctgatggacagataaacaaaatgtggtctacccatgcactggaatattagtcagccgtcaagagaatgaagtactgatacgtgctacaacattagtgaaccttgaaaacagtgaaaggagctagacacaaaagcccacatatcgtatggtcccatttatatgaaaagtccagaagaggcaaacccacggagacagaaagcagattagggaacgcctggagccgaggctaggagtgaccgtgtagtgagtctggaggtctccttctggggtgatgagaatgttagacaaccggacagaggtgatggttgaaccacactgcagatgtacttaatgcactgaattacatgcttccaaatggttaatttcacattacgtgaaattatgtgaattctacatcaatttttttaagtaagcccttgtcataaatgcgtttaatacagttgctgcctcagcatccaactttagcagttgtaccctgtcacctttgccctagataacacccctccctccctgtcatgtgattgtttgcgacatagcccacgtggtcctcgcctcactgacccaaaacccaacacatcccacggctgctgaccacgataagacctaatgctcaacaccagagtcatgtaaatcagtttcctcctcgtgcatgttttctttaaaccagccaatccacaacccccgcaggaaagcctgtgggatcacttcacaccctgtgaccttaatacaggcacagccccggaagcttccccgcccttccgttctgggcttcgctgttgcacagctgatgagctcaatcagctccctgctgcctccagacttcccctctgcctcccatcagcacacctaacatctcttcgatctgagtcatacatttctttttttttttttttttttttttttttgacacagggtcttgctctgtcacccagaatggagtgcagtggtgcaatcatgactcactgcagcctcaacctcccgggctcaagggatccccgctcccgctcagcctcctgagtagctgtgactacaggcacgcgccatcacgcccagctaattttttgatgtttttgtagataccgggtctcactatgttgcccaggctggtctcaaactcctgagctcaagcagtctgcccacctcaacctcccaaagtgctaggattacaggcgtgagcccccacgcccagcccatttctgctgtttcatgcattttcgtctgcctcctcactgtggctcccctgacacacacatccgaacctaactttcccacgggtcagggatctcctagaaactgggtatctcggctatggccactctcagtagagacatgccgagaccaaattaaaaagaaaccataatgataaaaaccacaacagccctcctgaaagcaaacggatttaactgtgataaacagcacaggacttgcagtatggattctcagtttgtgatgcaccagaggggacgcaacagtcacagggagcctggctggttgaaacacttctgtgtccagatcatgtaaaagttttgaagaagattttacggaagtatatgtttttaaaatgccatgaactcctgtgtcccctgcatctaacttagccacacagccagggtgtggtgaaatgctctcaggtccgcacttagcagccacgtagcctgcttgtgcctctgtgagactctgcttccccaaccataaagtaggcgtctgagggccaaagaacaaggctgcttaacctggtgccccagctcagttacgagcccgtgacaacagtgaaaaatcatcagcagccctttctcctcctgtagacctgcttgggccctgtagacctgcttttctgctcacgatgaacattagtaagggtaggctcgctgctgcagcaaacaaccagacatcccatgtcacagtccaatggggggtaccgggtcagaagtgcaggcttctagaatttgcagcaaaagtctgagagggggagagacagaggtattgccctgctccccggtagtcaccgctgtatcaagagggggcgaaagactcggatttgacaggggttaagagtttacctgagcacagcattctcattggcccctgtggcttggaaacatacggggaagtttgtaactgccaccaagttctgctgttgcttaatagaaagctgaccgggtaagtgtgattttcacaaaagggtctttgatgctcccaagattttagatttggttgccatgtcctatgaaaataatctgcaagagacgcctgtgactctgactagtcatctcattgacagtggttgccctgtaatattctttgattgtcctttaacagattcttaggccatgtaaacgctggcaagatttccctggggaaactaaagaggatgattcccacacgccgcttcccctgcatcaggcactaaaaggactgcggagttcttcttttcatgcaaatgctgagaatcttggctcacctaagggaatcgctgcctccctagccaggacgctggagggactggcgttaattagccacagactgcagcgagggggacagaatgtggcaccccctgagggcccatggaaacccagagaacggtcccaataggaatggagagaatccgttgagagattgggtttgcctttttttttttttttttttttttcctccaattggtaggccctagccttatcttagagggaaagaaaatcgagctagggcagggtgaggtggctcacaccagtaatcccggcactctgggaggctgaggcaggcggatcacgaggtcaatagattgagaccatcctggtcaacatggtgaaaccccgcctgtactaaaaatacaaaaaatagccggatgtgctggtgcacgcctgtattcccagctactcgggaggctgaggcaggagaatcgcttgaacccgggaggtggaggttgcagtgggccgagatcgtgccactgcactccagtctggcgacagagtgagactccatctcaaaagaaaaaaaagaaaaagaaaatcgagctactgcacggtgcggagaaagcattcaccagaaggcagtcatttttgaaataagtatctgagacccggcctgtgccccagctcagctaggagcacatgtgaagagaccagagctggcgaggcgactccggtcctgactcccaccttcccagccgactgggaccaaaggacgccacctccctaactagtgccaggtgtctaccggactcttgccacccccatgttgtcccctgccaccacagggtcagggccagccgctatgccgctgcaaccacccggcaggggctgccaagctggagcattttcgctagcaagggtcaaggcaggtgtgggactgcagggagagggctggctcgccccactgcagggcccagtcgctaaaagaagcatggacctgctcttccaactggcccctcaccctggctctccaggctcctgtcctggctccctttcaccctcccataggtggctcctgggagcggttcctcctctgcttccagtccccagagccaaggcctcacctacacttctcctcctgaagggactccagcaacagctgcaggtcagtcagagacctctcctttaggctgtgataggactcctggaggctgatgtggaacctcttggcttcttccagctctgcctttaccttctgcaacagcaggttttgttgctgggccacatcctctgtctctaagcacgtcccctgctgtaagctctggaagcgactctccaagatgaagggcctgctggcatgaggcaggttgaccggcccgtcttccccacctggctcggggggctctgaaagcagggccttctcactgggtggctcgcagttggctgggtcgctttctgccatcagcagtaagccctcgggcctgcagccttcctccagctcctggagctgctggtgacactggtggagcctgtgctcgatctgggcgatggtggcagaggcgcgctggttcaccttctcaaaggcctgctggatgtgcggcacctggtgccggtctgctttggataccagcttgaggtagctcacagtgttgccatcccgactggccttctccactctcagctgctctgagaggtagaggatgcggtgcctgacactatcctgtaagttgtgggctaggcctccatctgcgaggctggaagggccactggggccgtcttcgctggatgacagggaccggcatgaaggcacattggaggggagggttgcgctggggctcctggtgtgttccgcctacgttgggaaacaagaaatcacaatacggtgctctgtgagccgcaaagtgtgggagaattggacacgttatgactccataaaacacttccacatatgcatggatacttacacacgcaagatttgtgcattcaagatgggcccgacacagactgaggaggtgatgctcatcttcagggcccctctcccctccttttcagcgtctgactccttgctctacatgtgtgcctcactaagacccacaggtggccagactcccttctacatctgcctgtttttgcactgcactcctattttctcttccaaaaattaccaattgtgggtctcatttataaagaactgttcttgtaaagtatggaataagcttatttccgtcaactcttacagcttgctgtattgctactcccagggagacaggaagggttaggcagagagatttgcctcctaacaggttcattcattcatccaatcattcattcaacacatactttctctgagtgcctaccacgtggtacagaagccagatacattctttgatctcatacagctgacagtctacggcagaaaattctactgtaacacaaaagaatgagtctctcacatggtgaggggattaacattgcctttgacgaagagcccagttcaaatcctggctctaccactctgagaccttgagcaagttaataaactgctctgaggctcagttttcttacctctaaaataaagatggcaagagcagcatagctggaacccagcccaccagagcaaggagctaggagagggaggtggggggcagctcaggtgcagcctctgttccgtttctacttttttgttttttgagacggagtctcactctgtcacccaggctggagtgcagtggtgcaatctcggctcactacaaccttcgcctcccgggtttaagcaattctcatggctcagcctcccgagtagctgggattacaggtgtgcatcaccacacccagctaattcgtgtattattagtagagacagggtttcaccatgttgaccaggctggtttccaactcctgacctcaagtgatcctcccgcctcggcctcccaaagagtgctgggattaccggtgtgagccactgcatctggcctatacctcaatttttaaaatgcaaagtgataccactatgtacccagtagattggtcaaactcagacagactaacaacaataagagttggcaaggatatagcgcaacaggaactctcaatcattactggcgggaagcaaatttgtactacagccaccttagaaaaccacttgacagtatcacaaagttgaagatatacctaccaaatgatccagcaactgcattcataggcgatattcccaggaggcaagtacactgatgttctcaatatccaacaactagcaacaaaccacctgcccagaaagtgtaagtaaactgtaatatatgcaacaacatactactgtacagcaatgagaatgaactacagccttgaaaaacatgaatgcatttcacaagcataatgttgaacaaaagaaaccagacagaaaatccatactatatatggttccatttacataaattccaagagcaggcaaaactaaacaatattgtgtagggatgactacacaggcaggaaagctaaagagcagcatggatgttggcaacagaaaccccaggatggtggttcccactagagcgggagaaggggattatgactggggtgactgtggaggctggggtgcctggcctgagtagtggttaaatgtgtgttcaccttatcgttacttcttaaaacatacatcaatgttttctgcacctttatatacatatgccagatttcacagttttcaaactatttaaatgttcaatataggccaggtgtggtggctcatgcctgtaatcccagcactttgggaggctgaggcgggcggaggtcaggaggtcaagaccagtctggccaacatggtgaaaccccgtctatacaaaatacaaaaaaaaaaaaaaaaatgcctggcacagtggttcacacctgtacttccagcactttgggaggccgaggcgggcggatcacctgaggtcgggagttcaagaccagcctgaccaacacagagaaaccccatctctactagaaatacaaaattagccaggcgtggtggcacacgcctgtagtcccagctactcgggaggctgaggcaggagaaccgcttgaacccggggtgcagaagttgcagtgagctgagatcgtgccactgcactccagcctgggtggtagagtgagactccgtctcaaaaaataaataaataataaataataatatgttcaattgatggatttaatggcagatttgatatggctggagagactgttggtaaattgtacagaggagctaaagaaagtatccaggccgggcgcggtggctcacacgcctgtaatcccagcattttgggaggccaaggcgggtggatcacctgacgtcaggagtttgaggctaacctgaccaacatggtgaaaccctgtctctactaaaaaatacaaaaaattaactgggcatggtggtgggcacctgtaatcccagctacttgggaggctgaggcaggagaatggcttgaacccaggaggcagaggttgcagtgagccgagatcacgccactgcactccaacctgggcaacaagagcaaaactccatcccaagaaagaaagagagagagagagagagagagagagagagaaagagaaaagaaagaaagaaaaaaaagtatccagaatgcagcacagaggcacaaaaaaatagaaaacttgaaaaatagaagacatggaaggtagcatgagtaggtctaacaaaaatccaattgtcacaccagagagagaagacagacagaatgaagcagcagcaatatatacatatttttcttcttttttttttaaattgaaatggagtcacactctgttgcataggcggagtgccgtggcacaatctcggctcacggccgacctctgctgcccgggttcaagcacttctcgtgcctcagcctcccgagtagctgggactacaggcgcgtgccatcacagctagctaattcttttgtatttttagtagagatggggtttcatcatgttggcaagactgttctcgaactctcaacatcaggtgacccacccacctcggcctcccaaagtgctgggattacaggcatgagccactacgaccggccacagcagcaacattttaagagataactccctaagaactttccagaactgaagaaagacacaaattcacaaattcaagaagcccaataaatcctaagcagggaagacagaaataggtccacacctagacacgagattttttttttttttttttttttgaaacagtgtttcgctcttgtcgcccaggctggagtacagtggcgtgatctcggctcactgcaacctctgcctcccgggttcaagcgattctcctgcgtcagcctcccaagtagctggtactacaggcgcccgccaccatgcccagctaatttttgtatttttagtagagacagtgtttcaccatgttggccaggctggtctggaactcctgacctcaaatgatccgcccacctgggcctcccaaagtgctgggattacaagcatgagccaccgcccgcggccgacacaagatgttaaaagcagccagaggaaaaaaagctgattacctttaaaaccatgacttttagacggcaggctgccttctcaatagcatcaatgcaatccagaagatagttgactgatatcttcgatacactgagagaataactgtcagagagaaaaaaataggtcacattcaaagaatcagaagtcagaatggcttcagacttcagcaacagcatggggaactagaagacaatgaagtgctggccgggcacggtggctcacacctgtaatctcagcactctgggaagcccaggcaggcggatcacttgaagtcaagagtttgagaccaggctggccaacatgaggaaactctgtctctactaaaaatacaaaaattagccagcattgtggtgggcgcctgtaatcccagctactcgggaggctgaggcaagagaatcgcttgaacccaagaggttgcagtgagccgaggatcactcccctgtactccagcctgggcgacagagcaagactctgtcccaaaaaaaaaaaaaaaaaaaaaaaaaaaagacaatgaagtgctgctttcgaaattctgagggaaaaatgatttcccagcctaaaattctacaccccaactgtcaactgtggggttagactaaagacatttttagacatgaaggagttcagtacaccactgacaaatgtaagaattcaacaactgtttaaaaagcaagtcttgccagggcagtggtgtgcacctgtggtcccagctactcaggatgctgaggcaggaggattacttgtgcccagcaagtagaggctgcagtgacctgtgactgtgctactgccctccaacctgggtgacagagtgagaccttgtctcaaaaaaaaaagagcgggggggggggggccgggccgggcgtggtggctcacagctgtaatcccagcactttgggaagccaaggcgggtggatcacttgaggtcaggagtttgagaccatcatggtcaacactgcgaaacactgtccctactaaaaatacaaaaattagccgggcatggtggcacacacctgtaatcccagctactggggaggctgaggcaggagaattgcttgagccggggagacggaggttgcagtgagccgagactgcgccactgcactccagcctgactgacaagagtgagattgtctcaaaaaaaaaaaaaaagtaatcactagaaaagaagctacatatgtacataacatccaaataaccaagaggagaaaaaaatgggacttgattaatcaaaacaaaaacaaaaaagaaagaaagaaagggggagaaaataaaacaagggctgggtgtgctggctcatgcctgtaatcccagcactttggaagccaaggtgggtggatctcttgagctcaggaggtcaagaccagcctgggcaacatggcgaaaccccgtctctattaaaaaaaaaattaatacaacaattatcctggagtggtggtacacacctgtagtcccagctacccaggacgctgagacgggaggatcgcttgatcccggggatgtcgaggctgccgtgatcgcaccactgccctccagccagggtggcagactgagaccccatctcaaaaaataaataaataaaagcaaacaagaaaaaaaaaggcttgaaacatatctgatagataaagggctaatcaacacaatatataaagaactgcaaatcagtaaactaagagcaaataacccaatataaagacattaaagggtagccacggacatctcagacgacgaaaaacaaaagacagtaaacgtataataaaacatgtaattgcaaggtgatccgggaatagtaagcgaaaagcaacaattaaatactattttctcatccaccagaacgccaaaaattaaaaagcctaacaatgtccagggctggcgagaatgtggcagaaggtgatgtcacataccctgcaagtgggaatctaaacagattcagggttttggtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatttgccactaagcccagctaattgttttttatttagtagaaacggggtttcaccatgttagtcaggctggtcgggaactcctgacctcaggagatctacccgccttggcctcccaaagtgctgggattacaggcgtgtgccactgtgcccagccacttttttttagacagagtcttggtctgttgcccaggctagagttcagtggcgccatctcagctcactgcaacctccgcctcccagattcaagcgattctcctgcctcgacctcccagtagctgggattacaggtttccagcaaatccctctgagccgcccccgggggctcgcctcaggagcaaggaagcaaggggtgggaggaggaggtctaagtcccaggcccaattaagagatcagatggtgtaggatttgggagcttttaaggtgaagaggcccgggctgatcccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaagacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcggcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggcggagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccgggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgtccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgtgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagttcgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaacagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagtgatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggaccacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattcacctgttcttccatcaatgcttgccttgggagcaaaagagaaagtgagattccttcagtacctcatccagagctcatgccaacagcgagcggtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatgtccagaataggcaaatccatagagacagaaagcagattagtgggtgccaggggctgggggtgggggatgggcagtggctgctaatgagtacagggttgctttggggctggtgaaaatattgtaggaccgggcacggtggctcacgcctgtaatcccagcactttgggaggccaaggcgggcggatcatgaggtcaggagatcgagaccatcctggctgacacggtgaaaccccgtctgtactaaaaatacaaaaaaaaattagccgggcgtggtggcggacgcctgtagtcccagctactcgggaggctgaggcaggagaatggcgtgaacccgggaggcggagcttgcggtgagcagagttcacaccactgcactccagcctgggcgacagagcgagactccgtctcaaaaaaaaaaaaaagagaatattgtggaattagatagtggtgatggttgaacaactctgtgactatacgaaaaaccagtgaattgtacactttaaattggtgaattttatgggatgtgaattatatctcaatagagccgttatttaaacaaaaagagaaaagtgaatcatggcaatagttgcgcaactcagtaaatttactaaaaaccattgaaatgtagttaaaatggtgcattttataatatgtaaattatatctcaatagagctgttaaaaaaccacaagcaggccaggcgcagtggttcacagttgcaatcccagcgctttgggaggccaaggcaaggggattgtttgaggccaggaggaattcaacaccagcctgggcaacacagtgagaccctgtctctacaaaaaaaatttttaattatctgggtgtggtggcacgcgcctgtagtctcagctactctggaggctgaggcaggaggacctcttgagtccgggagttcgaggctgcagtgagctgccatcacgccactgcactccagcctgggcagcagagtgagaccctatctctaaaagaaaacaatcactacctgttgtgtatataattatataagtagtaaaagtataaaaccatgcatggaaaagataagcacccaaatgagaatggtgaggccagtatagcaaggccagaatagcaaggaagggagatggtgctggaaaggggtaatgagggcttcaacagaatattttaaagttttatttcctaaaaaaataagatttgaagtgaatatggcaaatgttaagatttcagaaagctggggctgttaattatgttatccttacattttccctttgcttgaaatacttcataatttaaaaacttctatgaagttccccttttggcaccacaaagaacgggccagaaggacagaggccagggggccagtgagggggctctggcaccaccgcttacgtagaagagagaaggcaccagagcgtgatggaacccatagactggcagggctgccgccccaggaggcccaggagggtggcggcaggcctcaggtgcaggaggtctaaacggtggtgctgacagagacggggaaaacagtgacgacttctattcggtcccactccaaggacttgaccaacacccacacggagaaatcccccgggcactgaataagctgacagctcatttgttgaaagccaatttgtcaaaagctggttcctcgcagcatttcaaggaatattccatttgtctctgccccaggtccctgttaagaagagagtcggtggacaacatggactaggccactgctcacagagagggggagtgggtcggcaggatggtcaccccgaaaatagattcctcattactgtctttccatttacatgaatgatctagctgtgagaacattcaagattttaactgtcctcaggaatatgaagtcaatcttcatcaatgtattggtaaagatacatgaagatattcttcagtgcattcttgaagagtctcttcagatgtcagtaaacaatattttcataaggatattctctcagtctccccttctctctggcccccatctcctggccctctggcagccgcgctcccttctcttccttggtcaaggacccccctctctccacctcctacagtcacagaagcaaatggacaactctggagaatgctcttatgaacacaaaacgatgaccagtcaacccagacaccctcaagacagaccgaaggtgttaagaccaccctctccaacacaaagtgttctaaactttattgtttttttcaaaatagtgttgttgttttttttttttgagacggatctccttctatttgcccaggctggagtgcagtggcacgatcttggcttgctgcaacctccgcctcccgggttcaagtgattttcctgcctcggcctcctgagtagctgggactacaggtatgcgccatcatgccgggctaattttttgtatttttagtagagacagggtttcaccatgttggccaggctggtctccaactcctgacctcaggtgacccgcctgcctcggcctcccaaagtgctgggattacaggtgtgagccattgggcccagccagaaagagtatattcttggtcatttctgagaatttgcttttggcaaattgagctagagcctaatcatggcccacaacttggaggaaaagtctgagacggagaaacagctgtaggaggggtcaatagcccaggtgcaatcggtgcatgtggccaggatggatgagctcactctgagcaaatgtgccaaagcaaggggccctggggagctgggggaagagccaacaaaacagaagcgaaagcaggaggaaattcgccaggacggctcacacaggaacccagaggatgtagggatacagtggaaaggttgaacatacatgtaactggggccttagaaggggaaaaatgagagactagggcagagtcactatttgaaaatataatggctgaaaacgtccaaaactgacaaaagacatcaagccataaacccaagtagcaatgcgaagcccaagcaggatgaatgcaaagaaaatcacaccaaggggagagtcagcggcacaaaaaagaagagagaaagaaaatcacgccaaacatcatcatagcaaaaccactaaacaacaaagaaaaacaaaagatcttaaaaggagcctgaggaaaacaaaactgtgatccgaggagcaacaagaagactggcagctgccttttcaacagaaaccatggaagtcagaagggaatgatttgttcaaaatgcttattatttccaaaaattaagtgccaacttagaattctatgtccagcaaaaaatatccttcagggccgggtgtggtggctcacgcctgtaatcccagcactttgggaggccgaggcaggcagatcacgaggtcaggagttcaagaccagcctggccaacatggtgaaaccccgtctctactaaaaatacaaaaactagccgggcgtggtggcacatgcctgtaatcccagctactgaggaggctgaggcaggggaatcgcttgaacctgggaggcagaggttgcagcgagccgagatctcaccattgcactccaacctgggtgacagggtgaggctctgtctcacaaaaaaaaaaaaaagaattccttcagaaataaaaaggaatgatggcatgtgtgaggcaataaggtgacagtgactgcatatttaacattgtggacttgttttaaaacatttttggtatggtatttaggctatgttaacaaaatgatccatatttcaggttcacactgaaatatttacagatgaactgatataatgtctgtgctttgcttcaacgcaatagggatgagaggaaccagttcagagagcagatcagaccttaggtcagacctcctcagagatcccaagatgcaggatgctgtgacatggaggagaagtcggggaaaaaatggaagttaacacgaccccagcctgcaacaaagccctaagcagataccttgaggaaagtcagcccgaggctggatccctggggctgagaggtcacagagcaacactgaagcctctaggaaccatagcctgttatctccaagcctcgtctgaaagcgaaacataccagaacagtcttgggacagaggagctagggtctggatgcccccaaggacctcgtgtccaggagggaaagaaaaacatggagacctggcatattcacttccgggcgttttcaatatgacaggaggctataagaaaatttcacgactgcccacttgtggatacagccagaaatacaaagcaagagtgaaagttttgcctactcggcacctgagtagcttcttttttattcaatttttattgaggtaaatttcatgtaacataaaatgaattattttaaggtgaacaattcagcggcatttagcacatgtggtgttgtgcaaccaccatggctattaatagttccaagacattggccggctgcagtcatgcctgtaatcccagcactttgggaggccgaggcgggcggatcacgaggtcaggagatcgagaccatcctggccaacatggtgaaaccccgtctctactaaaatatgcaaaaattagctgggcgtggtggtgcatgcctgtaatctcagctactcaggaggctgagacaggagaatcacttgaatccgggacgcagaggttgcagtgagctgagatcaagccactgcactccctccagcctgggcagcagagcaagacaccacctcaaaaaaaaaaaaaagccattaacaactttctttctttctttctttctttctttctttctttctctttttctttctctctctctctctctctctctctctctctctctctccctctctctctctctctctctctctctctcctctctctctctctcctctctctctctctctctttctgtttttttttttgagacaagttctcactctgtcctctatcacccaggctggagcacagtggcacaatcatagttcactgcaacataaaactctcgggctcaagcgatcctcctgtctcagcctcccatgtagcagggactacaggcatgtgccaccaagtccggttaacacttttaaaattttttgcagagatatggtctcactttgttacccaagctggtctcagactcctgggctgaagcaatcctcctgcctcgacctcccaaagcactgggattacagccataagccaccacatctggccccatttttctttacgatctttcaaggacttagtttgcacataggaagcagaaaggaattgtaaattcagttccatcagcatctacttggggcttacacacaagtattaattaattctcacaacagttccaacaatagtgggatcatttttacctccatgttacagatgtggaaactgaggattgcaaacttgaagcacctcgtccaaggtcattcagtaaataccttgcagagaggaggctgggccaggcctaaatccagaatcagccctcctggccctgccctgatgttcccaagacacagcagatagagttctgacatacatggaggagggaggcagcccagagggcgagctgggtcccttcaggaagggaggaaaagcagcatccagactgatccatgaaacaggtactcacagaacagccatcatgtgccaacatgtctttgggcagtcactcagacacagtggccgacctgaatgtgctgatattttgacgagaacaatacaacacaaatgaatacctacacaagggagagcagtttaggcggtgagtgctgcgagaaaggaaaaagtaggggagtgacaaagactggtccggagtatataaagagctctgacaactcaacaataaaaagacaatccaagttgaaaacaagccaaagacttattggctgataagcacatgaaaaggggttcagcatcattaatcgtcagaggcagggtcacacacccactagtctcatgggctaggatactggttctcaaccaggggcaatttgccggcccccccctccccaaacaagggacatttggcaatctctggacagacatttctggttgttacaaataggtggggcacggtaggctaaaattgcccccctaggctgggcacggtggctcacatctgtaaccccagcactttgtgaggctgtggtgggcagattacctgggctcaggagttcaagaacaccctgagcaacagggtgaaaccccgtctctatgaaaaatacaaaaaaattagctgggtgtggtggcacgcgcttgtagtcccagctacttgggaggctgaggcaggagaattgcttgaacccaggaggcggaggttgcagtgagccaagatcgtgccactgcactccagcctgggtgacagagagagactctgtctaaaaaagaaaaaaacaaaaagcccctccgcaaaagatatctgtgtcataatccttggaaactgtgaatgttaccttctatgaccaaaaaagggggctttccagaagtggtgagtttaagggtattgagatgcaaagattatcctagattatcctggtggccctaaatgcaatcacatgtatgagagagaggcagaaggacattagacacacacagacgagaatgtcatgtgaagacagaacacaggtttgaagatgctggccttcaggacaggaatgatgtggccacaaaattaaggaatttggcagccaccagaaactggaagaggcaaagatcagtttgtcccctagagcctccaatgagtgtgtgtcctcctcgcctgatttcagcccagtgaaacggatttcggccttctagcctccaggactgcgagagaataactttctattattttaagccatgaagttgggggcaatttgtcacggcagcatcaattaattcacggcaccactggcatcaagtaagtggagaccagggatgctgctcatcatcctagaatgtacaggacagccccgcacaacagagaatcattcggtccaaaatgtcgacagtgccaaggtcgagagaacatgggctagggtgatgaaattttggagtctaatttcaccaagttgtggctgaacttaagaggctgacatttaaaagactgatcttgccaaacgttggcaactggaactcttatacactcctagcgggactgtaaaatggtatagccatgtcggaaaacagttcctcttttttttttttttgagatggagtttcactcgttgcccaggctggagtgcaatggcacgatctcggctcaccgcaacctccgcctcctgagttcaagcgattctcctgcgtcagcctcccgagtagctgggattacaggcatgtgccaccacgccgggctaattttgtatttttagtagagacagggtttactccatgttgttcaggctggtctcgaactcccgacctcaggtgatccgcctgcctcagcctcccaaagtgctgggattacaggggtgagccaccgcgcccggccttcctctttcttaaaaagttaagcatactgctatggggtacatgtcccccccaaaactcgtgttgaaatttaatggccatgtgatggtgttaaggggtgggactggtaagaggcgattaatattaatattgttatcatgaaagtttggcccccgctcgctctctcacgccctcttgcccttctgccttccgccataggatgatgccgtacaaaggtcctcaccagctgccagcgccttgacattgaacttcctttctttataaaccacccagcctgcggtactctgttacagcaacagaaagtgggactaagacacataacacttccctgttatctagcaattccatatatgaaagcatatgttcacagaaagacttgtgcgagaacgttcatagcagctttattcagtcgccccaactggcagcggaccagggcataagcaacctgcggcgtctccatgcaatggaaggctgccaagcaatacgaagccatgagctactcacttcacacagcttgggtggatctcaaaacaattccacggagcgaaagccgccagacacaaagcactgcgtgccgtgcgattccacttacgtgaagttcaaaaggagatgaagctagagtgacagaaaccggaacagtggccaattatgggagacgggcattcactggaagagggtatgagggtactttctggggtggtggcaaagctctttattgggattttagctgcccaggtgtaaacctttgtcaaaactcgttaaactgtatgcctaaacttaaatgcaatttcactgcataaaatttacctcaaaaaggccaggcgcggtggctcactcctgtaatcccagcactttgggaggccgaggcaggtggatcgcctgaggacaggagttcgagaccagcctgaccaacatggagaaaccccatctctactaaaattacaaaattagccaggcgtggtggtgcctgcctgtaatcccagctactcgggaggctgacgcaggagaatcgcttgaactcaggaggcggaggttgcagtgagccgagattgcgccattgcactccggtctgggcaacaagagcaaaactccatctaaaaaaaacaaaaaaacaaaaactttacttcaaaaaaccccgcttccaaaagaataaaagaagaggccatttgaacgtggtagcctgggaagtccctttgaggagaggacatcagagcagagcctaaaggacaagctgagtgtgggagtttcctctggctgccatcacaaagcgttacaaactttgagtggctttcccagcagagatggcctctctcctggctgggggtccagcagtccgagaggaaggcccaggctgggcgggctcctgccgaggaccgagaaggcgcctccactcggggcctctgtcccagcttctgctctgctgcccacctgcgggcttccttggcttctgccacggcaggtcggcctcagcctctgtctccacacggcgctctccctctgggtgtgtccgtgtctccgtctcccctttctgtcaggacacaggtcacactgcattagggcccacccctctgcagaatgacctcatccagatctaactcatcacgtccgcaacgaccctgtttccaaataagccggttccttgtcaccaagtggagccttcaatgagttgatgccaaggcaggtctagggaactagaaatggggcaagaagcaatgtcctccagccaggtgtggtggctcacacctgtaactccagcactttgggaggccgaggcgggtggatcgcttcaggtcaggagttcgagacccctggtcaacatggcgaaaccccatctctactgaaaaatacaaaaagtagccaggcatgctggcgtgtgcctgtaatcccagctactcgggaggctgaggcaggagaatcgcttgaacccgggaggtggaggttgcagtgggccgagatcgtgccactgcactccagcctgggggacagagtgagactccatctcataaaaaagacaaaaaaaagaagcaatgtgctcctcacagtcgggttttctcccaggaccattttactcatccaacaaagaacaaagatgtcccagcaacccatctaccccaggcattgaccactcgggctacaaaggtgaaggaggagggtggggctgggcaggctgggactggctatggaccccagagagtaaagatggttttgctggcaccatacccccaactccaggacttgtccatgccctgtctacggggccaagactgaaacctgactgcctttcaccatcaagcagaagtcagctgcgcatcctgtaagagatggggaaggacccccaagaccctcccagagccccctggctcattaggaggctagagggggcctcctgcaactctgcatgcaaggtgcccagatgagacctggccagtcgagacttttacttgaaggctccccatgccttcctggggtgccatctcttctaccaatgaacattttctgagtttctcaagccttctttcctcctgacccacgaagaaactgagggaccggggccttctggtcccccaggagactggcttgtgctgaggaggtaggccgctcactgtgcatcttctcggagatctgaagctcctcctatttccacaagaaagaaagggaagcttggcaaagacccttccatccagaatcatcaagttcgcgacgcccgtgcttctcctcagcacacagagaggagagttaccaggggcctcaagcaactccagcggaagcagtcacagtccttccaggacccaggaacgtcctctgcaaggacctacaaacccagacctcatgaaggaggagaccccagggccagccccaagcctcctgagtctaattgttgctgtgatagagaccctgcacgtcgcagaatcaaaaagaatatattgtgggtttttttttttttttaccacaatcaattaaaaaatgcattaaaaagtaagaactgtccaggcacagtggctcacatctgtaaccccagtacttggggaggccgtggccaggtgttcaagaccagcctgggcaacatagcaagatcccatctctacaaataataataatttttaaaaagttagccaggcatggtggcacatgctttgtactcccagctactcgggaggctgaggcaggaagatcgcttgagcccgggagttcaaggctgtagtgaactatgactgcatgcagcctgggcaacagagaccctgaagaaaaagaaagaaagaaagagagatagagagagagagagagagacagagagaaaggaagaaagagaaagagagaaagaaaaagaaagaaagagagagagagatggaaagaaagagagaaaaagaaaaagaagaaagaaagaaagaaagaaagaaagaacttttgcctatccaaagactcaggaaaaataaaaaagaaagccagccctcataatgagataccacttcacagttacatctgttggaaaaaaaaaaaaaggataacaacaaatgttggcaaggatgtgaggcaactggaagccttctgcattgctggtgggaagatggagctgcgcggctgctgtgggaagactcctctaaacgctacacctggagtcaccacggggtccagcaattctactcctgattatagaccccaaagaattgaaaactggtgttcaaacaactggcatgtatctgagtgttcagcgcagggcttctcacaatagccaaaaggtggaaacaactcaaatctccatccactgatggacagataaacaaaatgtggtctacccatgcactggaatattagtcagccgtcaagagaatgaagtactgatacgtgctacaacattagtgaaccttgaaaacagtgaaaggagctagacacaaaagcccacatatcgtatggtcccatttatatgaaaagtccagaagaggcaaacccacggagacagaaagcagattagggaacgcctggagccgaggctaggagtgaccgtgtagtgagtctggaggtctccttctggggtgatgagaatgttagacaaccggacagaggtgatggttgaaccacactgcagatgtacttaatgcactgaattacatgcttccaaatggttaatttcacattacgtgaaattatgtgaattctacatcaatttttttaagtaagcccttgtcataaatgcgtttaatacagttgctgcctcagcatccaactttagcagttgtaccctgtcacctttgccctagataacacccctccctccctgtcatgtgattgtttgcgacatagcccacgtggtcctcgcctcactgacccaaaacccaacacatcccacggctgctgaccacgataagacctaatgctcaacaccagagtcatgtaaatcagtttcctcctcgtgcatgttttctttaaaccagccaatccacaacccccgcaggaaagcctgtgggatcacttcacaccctgtgaccttaatacaggcacagccccggaagcttccccgcccttccgttctgggcttcgctgttgcacagctgatgagctcaatcagctccctgctgcctccagacttcccctctgcctcccatcagcacacctaacatctcttcgatctgagtcatacatttctttttttttttttttttttttgacacagggtcttgctctgtcacccagaatggagtgcagtggtgcaatcatgactcactgcagcctcaacctcccgggctcaagggatccccgctcccgctcagcctcctgagtagctgtgactacaggcacgcgccatcacgcccagctaattttttgatgtttttgtagataccgggtctcactatgttgcccaggctggtctcaaactcctgagctcaagcagtctgcccacctcaacctcccaaagtgctaggattacaggcgtgagcccccacgcccagcccatttctgctgtttcatgcattttcgtctgcctcctcactgtggctcccctgacacacacatccgaacctaactttcccacgggtcagggatctcctagaaactgggtatctcggctatggccactctcagtagagacatgccgagaccaaattaaaaagaaaccataatgataaaaaccacaacagccctcctgaaagcaaacggatttaactgtgataaacagcacaggacttgcagtatggattctcagtttgtgatgcaccagaggggacgcaacagtcacagggagcctggctggttgaaacacttctgtgtccagatcatgtaaaagttttgaagaagattttacggaagtatatgtttttaaaatgccatgaactcctgtgtcccctgcatctaacttagccacacagccagggtgtggtgaaatgctctcaggtccgcacttagcagccacgtagcctgcttgtgcctctgtgagactctgcttccccaaccataaagtaggcgtctgagggccaaagaacaaggctgcttaacctggtgccccagctcagttacgagcccgtgacaacagtgaaaaatcatcagcagccctttctcctcctgtagacctgcttgggccctgtagacctgcttttctgctcacgatgaacattagtaagggtaggctcgctgctgcagcaaacaaccagacatcccatgtcacagtccaatggggggtaccgggtcagaagtgcaggcttctagaatttgcagcaaaagtctgagagggggagagacagaggtattgccctgctccccggtagtcaccgctgtatcaagagggggcgaaagactcggatttgacaggggttaagagtttacctgagcacagcattctcattggcccctgtggcttggaaacatacggggaagtttgtaactgccaccaagttctgctgttgcttaatagaaagctgaccgggtaagtgtgattttcacaaaagggtctttgatgctcccaagattttagatttggttgccatgtcctatgaaaataatctgcaagagacgcctgtgactctgactagtcatctcattgacagtggttgccctgtaatattctttgattgtcctttaacagattcttaggccatgtaaacgctggcaagatttccctggggaaactaaagaggatgattcccacacgccgcttcccctgcatcaggcactaaaaggactgcggagttcttcttttcatgcaaatgctgagaatcttggctcacctaagggaatcgctgcctccctagccaggacgctggagggactggcgttaattagccacagactgcagcgagggggacagaatgtggcaccccctgagggcccatggaaacccagagaacggtcccaataggaatggagagaatccgttgagagattgggtttgcctttttttttttttttttttttttcctccaattggtaggccctagccttatcttagagggaaagaaaatcgagctagggcagggtgaggtggctcacaccagtaatcccggcactctgggaggctgaggcaggcggatcacgaggtcaatagattgagaccatcctggtcaacatggtgaaaccccgcctgtactaaaaatacaaaaaatagccggatgtgctggtgcacgcctgtattcccagctactcgggaggctgaggcaggagaatcgcttgaacccgggaggtggaggttgcagtgggccgagatcgtgccactgcactccagtctggcgacagagtgagactccatctcaaaagaaaaaaaagaaaaagaaaatcgagctactgcacggtgcggagaaagcattcaccagaaggcagtcatttttgaaataagtatctgagacccggcctgtgccccagctcagctaggagcacatgtgaagagaccagagctggcgaggcgactccggtcctgactcccaccttcccagccgactgggaccaaaggacgccacctccctaactagtgccaggtgtctaccggactcttgccacccccatgttgtcccctgccaccacagggtcagggccagccgctatgccgctgcaaccacccggcaggggctgccaagctggagcattttcgctagcaagggtcaaggcaggtgtgggactgcagggagagggctggctcgccccactgcagggcccagtcgctaaaagaagcatggacctgctcttccaactggcccctcaccctggctctccaggctcctgtcctggctccctttcaccctcccataggtggctcctgggagcggttcctcctctgcttccagtccccagagccaaggcctcacctacacttctcctcctgaagggactccagcaacagctgcaggtcagtcagagacctctcctttaggctgtgataggactcctggaggctgatgtggaacctcttggcttcttccagctctgcctttaccttctgcaacagcaggttttgttgctgggccacatcctctgtctctaagcacgtcccctgctgtaagctctggaagcgactctccaagatgaagggcctgctggcatgaggcaggttgaccggcccgtcttccccacctggctcggggggctctgaaagcagggccttctcactgggtggctcgcagttggctgggtcgctttctgccatcagcagtaagccctcgggcctgcagccttcctccagctcctggagctgctggtgacactggtggagcctgtgctcgatctgggcgatggtggcagaggcgcgctggttcaccttctcaaaggcctgctggatgtgcggcacctggtgccggtctgctttggataccagcttgaggtagctcacagtgttgccatcccgactggccttctccactctcagctgctctgagaggtagaggatgcggtgcctgacactatcctgtaagttgtgggctaggcctccatctgcgaggctggaagggccactggggccgtcttcgctggatgacagggaccggcatgaaggcacattggaggggagggttgcgctggggctcctggtgtgttccgcctacgttgggaaacaagaaatcacaatacggtgctctgtgagccgcaaagtgtgggagaattggacacgttatgactccataaaacacttccacatatgcatggatacttacacacgcaagatttgtgcattcaagatgggcccgacacagactgaggaggtgatgctcatcttcagggcccctctcccctccttttcagcgtctgactccttgctctacatgtgtgcctcactaagacccacaggtggccagactcccttctacatctgcctgtttttgcactgcactcctattttctcttccaaaaattaccaattgtgggtctcatttataaagaactgttcttgtaaagtatggaataagcttatttccgtcaactcttacagcttgctgtattgctactcccagggagacaggaagggttaggcagagagatttgcctcctaacaggttcattcattcatccaatcattcattcaacacatactttctctgagtgcctaccacgtggtacagaagccagatacattccttgatctcatacagctgacagtctacggcagaaaattctactgtaacacaaaagaatgagtctctcacatggtgaggggattaacattgcctttgacgaagagcccagttcaaatcctggctctaccactctgagaccttgagcaagttaataaactgctctgaggctcagttttcttacctctaaaataaagatggcaagagcagcatagctggaacccagcccaccagagcaaggagctaggagagggaggtggggggcagctcaggtgcagcctctgttccgtttctacttttttgttttttgagacggagtctcactctgtcacccaggctggagtgcagtggtgcaatctcggctcactacaaccttcgcctcccgggtttaagcaattctcatggctcagcctcccgagtagctgggattacaggtgtgcatcaccacacccagctaattcgtgtattattagtagagacagggtttcaccatgttgaccaggctggtttccaactcctgacctcaagtgatcctcccgcctcggcctcccaaagagtgctgggattaccggtgtgagccactgcatctggcctatacctcaatttttaaaatgcaaagtgataccactatgtacccagtagattggtcaaactcagacagactaacaacaataagagttggcaaggatatagcgcaacaggaactctcaatcattactggcgggaagcaaatttgtactacagccaccttagaaaaccacttgacagtatcacaaagttgaagatatacctaccaaatgatccagcaactgcattcataggcgatattcccaggaggcaagtacactgatgttctcaatatccaacaactagcaacaaaccacctgcccagaaagtgtaagtaaactgtaatatatgcaacaacatactactgtacagcaatgagaatgaactacagccttgaaaaacatgaatgcatttcacaagcataatgttgaacaaaagaaaccagacagaaaatccatactatatatggttccatttacataaattccaagagcaggcaaaactaaacaatattgtgtagggatgactacacaggcaggaaagctaaagagcagcatggatgttggcaacagaaaccccaggatggtggttcccactagagcgggagaaggggattatgactggggtgactgtggaggctggggtgcctggcctgagtagtggttaaatgtgtgttcaccttatcgttacttcttaaaacatacatcaatgttttctgcacctttatatacatatgccagatttcacagttttcaaactatttaaatgttcaatataggccaggtgtggtggctcatgcctgtaatcccagcactttgggaggccgaggcgggcggaggtcaggaggtcaagaccagtctggccaacatggtgaaaccccgtctatacaaaatacaaaaaaaaaaaaaaaaatgcctggcacagtggttcacacctgtacttccagcactttgggaggccgaggcgggcggatcacctgaggtcgggagttcaagaccagcctgaccaacacagagaaaccccatctctactagaaatacaaaattagccaggcgtggtggcacacgcctgtagtcccagctactcgggaggctgaggcaggagaaccgcttgaacccggggtgcagaagttgcagtgagctgagatcgtgccactgcactccagcctgggtggtagagtgagactccgtctcaaaaaataaataaataataaataataatatgttcaattgatggatttaatggcagatttgatatggctggagagactgttggtaaattgtacagaggagctaaagaaagtatccaggccgggcgcggtggctcacacgcctgtaatcccagcattttgggaggccaaggcgggtggatcacctgacgtcaggagtttgaggctaacctgaccaacatggtgaaaccctgtctctactaaaaaatacaaaaaattaactgggcatggtggtgggcacctgtaatcccagctacttgggaggctgaggcaggagaatggcttgaacccaggaggcagaggttgcagtgagccgagatcacgccactgcactccaacctgggcaacaagagcaaaactccatcccaagaaagaaagagagagagagagagagagagagagagagaaagagaaaagaaagaaagaaaaaaaagtatccagaatgcagcacagaggcacaaaaaaatagaaaacttgaaaaatagaagacatggaaggtagcatgagtaggtctaacaaaaatccaattgtcacaccagagagagaagacagacagaatgaagcagcagcaatatatacatatttttcttttttttttttaaattgaaatggagtcacactctgttgcctaggcggagtgccgtggcacaatctcggctcacggccgacctctgctgcccgggttcaagcacttctcgtgcctcagcctcccgagtagctgggactacaggcgcgtgccatcacagctagctaattcttttgtatttttagtagagatggggtttcatcatgttggcaagactgttctcgaactctcaacatcaggtgacccacccacctcggcctcccaaagtgctgggattacaggcatgagccactacgaccggccacagcagcaacattttaagagataactccctaagaactttccagaactgaagaaagacacaaattcacaaattcaagaagcccaataaatcctaagcagggaagacagaaataggtccacacctagacacgagattttttttttttttttttttttttgaaacagtgtttcgctcttgtcgcccaggctggagtacagtggcgtgatctcggctcactgcaacctctgcctcccgggttcaagcgattctcctgcgtcagcctcccaagtagctggtaatacaggcgcccgccaccatgcccagctaatttttgtatttttagtagagacagtgtttcaccatgttggccaggctggtctggaactcctgacctcaaatgatccgcccacctgggcctcccaaagtgctgggattacaagcatgagccaccgcccgcggccgacacaagatgttaaaagcagccagaggaaaaaaagctgattacctttaaaaccatgacttttagactgcaggctgccttctcaatagcatcaatgcaatccagaagatagttgactgatatcttcgatacactgagagaataactgtcagagagaaaaaaataggtcacattcaaagaatcagaagtcagaatggcttcagacttcagcaacagcatggggaactagaagacaatgaagtgctggccgggcacggtggctcacacctgtaatctcagcactctgggaagcccaggcaggcggatcacttgaagtcaagagtttgagaccaggctggccaacatgaggaaactctgtctctactaaaaatacaaaaattagccagcattgtggtgggcgcctgtaatcccagctactcgggaggctgaggcaagagaatcgcttgaacccaagaggttgcagtgagccgaggatcactcccctgtactccagcctgggcgacagagcaagactctgtcccaaaaaaaaaaaaaaaaaaaaaaaaaaagacaatgaagtgctgctttcgaaattctgagggaaaaatgatttcccagcctaaaattctacaccccaactgtcaactgtggggttagactaaagacatttttagacatgaaggagttcagtacaccactgacaaatgtaagaattcaacaactgtttaaaaagcaagtcttgccagggcagtggtgtgcacctgtggtcccagctactcaggatgctgaggcaggaggattacttgtgcccagcaagtagaggctgcagtgacctgtgactgtgctactgccctccaacctgggtgacagagtgagaccttgtctcaaaaaaaaaagagcggggggtgggggggccgggcgtggtggctcacagctgtaatcccagcactttgggaagccaaggcgggtggatcacttgaggtcaggagtttgagaccatcatggtcaacactgcgaaacactgtccctactaaaaatacaaaaattagccgggcatggtggcacacacctgtaatcccagctactggggaggctgaggcaggagaattgcttgagccggggagacggaggttgcagtgagccgagactgcgccactgcactccagcctgactgacaagagtgagattgtctcaaaaaaaaaaaaaaaagtaatcactagaaaagaagctacatatgtacataacatccaaataaccaagaggagaaaaaaatgggacttgattaatcaaaacaaaaacaaaaaagaaagaaagaaagggggagaaaaaaaaaaaaacaagggctgggtgtgctggctcatgcctgtaatcccagcactttggaagccaaggtgggtggatctcttgagcccaggaggtcaagaccagcctgggcaacatggcgaaaccccgtctctattaaaaaaaaattaatacaacaattatcctggagtggtggtgcacacctgtagtcccagctacccaggacgctgagacgggaggatcgcttgatcccggggatgtcgaggctgccgtgatcgcaccactgccctccagccagggtggcagactgagaccccatctcaaaaaataaataaataaaagcaaacaagaaaaaaaaaggcttgaaacatatctgatagataaagggctaatcaacacaatatataaagaactgcaaatcagtaaactaagagcaaataacccaatataaagacattaaagggtagccacggacatctcagacgacgaaaaacaaaagacagtaacgtataataaaacatgtaattgcaaggtgatccgggaatagtaagcgaaaagcaacaattaaatactattttctcatccaccagaacgccaaaaattaaaaagcctaacaatgtccagggctggcgagaatgtggcagaaggtgatgtcacataccctgcaagtgggaatctaaacagattcagggttttgtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatttgccactaagcccagctaattgttttttatttagtagaaacggggtttcaccatgttagtcaggctggtcgggaactcctgacctcaggagatctacccgccttggcctcccaaagtgctgggattacaggcgtgtgccactgtgcccagccacttttttttagacagagtcttggtctgttgcccaggctagagttcagtggcgccatctcagctcactgcaacctccgcctcccagattcaagcgattctcctgcctcgacctcccagtagctgggattacaggtttccagcaaatccctctgagccgcccccgggggctcgcctcaggagcaaggaagcaaggggtgggaggaggaggtctaagtcccaggcccaattaagagatcagatggtgtaggatttgggagcttttaaggtgaagaggcccgggctgatcccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacaatatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatgtatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcagcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaagtaacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatttccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagcgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggacgacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattcacctgttcttccatcaatgcttgccttgggagcaaaagagaaagtgagattccttcagtacctcatccagagctcatgccaacagcgagcggtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatgtccagaataggcaaatccatagagacagaaagcagattagtgggtgccaggggctgggggtgggggatgggcagtggctgctaatgagtacagggttgctttggggctggtgaaaatattgtaggaccgggcacggtggctcacgcctgtaatcccagcactttgggaggccaaggcgggcggatcatgaggtcaggagatcgagaccatcctggctgacacggtgaaaccccgtctgtactaaaaatacaaaaaaaaattagccgggcgtggtggcggacgcctgtagtcccagctactcgggaggctgaggcaggagaatggcgtgaacccgggaggcggagcttgcggtgagcagagttcacaccactgcactccagcctgggcgacagagcgagactccgtctcaaaaaaaaaaaaaagagaatattgtggaattagatagtggtgatggttgaacaactctgtgactatacgaaaaaccagtgaattgtacactttaaattggtgaattttatgggatgtgaattatatctcaatagagccgttatttaaacaaaaagagaaaagtgaatcatggcaatagttgcgcaactcagtaaatttactaaaaaccattgaaatgtagttaaaatggtgcattttataatatgtaaattatatctcaatagagctgttaaaaaaccacaagcaggccaggcgcagtggttcacagttgcaatcccagcgctttgggaggccaaggcaaggggattgtttgaggccaggaggaattcaacaccagcctgggcaacacagtgagaccctgtctctacaaaaaaaatttttaattatctgggtgtggtggcacgcgcctgtagtctcagctactctggaggctgaggcaggaggacctcttgagtccgggagttcgaggctgcagtgagctgccatcacgccactgcactccagcctgggcagcagagtgagaccctatctctaaaagaaaacaatcactacctgttgtgtatataattatataagtagtaaaagtataaaaccatgcatggaaaagataagcacccaaatgagaatggtgaggccagtatagcaaggccagaatagcaaggaagggagatggtgctggaaaggggtaatgagggcttcaacagaatattttaaagttttatttcctaaaaaaataagatttgaagtgaatatggcaaatgttaagatttcagaaagctggggctgttaattatgttatccttacattttccctttgcttgaaatacttcataatttaaaaacttctatgaagttccccttttggcaccacaaagaacgggccagaaggacagaggccagggggccagtgagggggctctggcaccaccgcttacgtagaagagagaaggcaccagagcgtgatggaacccatagactggcagggctgccgccccaggaggcccaggagggtggcggcaggcctcaggtgcaggaggtctaaacggtggtgctgacagagacggggaaaacagtgacgacttctattcggtcccactccaaggacttgaccaacacccacacggagaaatcccccgggcactgaataagctgacagctcatttgttgaaagccaatttgtcaaaagctggttcctcgcagcatttcaaggaatattccatttgtctctgccccaggtccctgttaagaagagagtcggtggacaacatggactaggccactgctcacagagagggggagtgggtcggcaggatggtcaccccgaaaatagattcctcattactgtctttccatttacatgaatgatctagctgtgagaacattcaagattttaactgtcctcaggaatatgaagtcaatcttcatcaatgtattggtaaagatacatgaagatattcttcagtgcattcttgaagagtctattcagatgtcagtaaacaatattttcataaggatattctctcagtctccccttctctctggcccccatctcctggccctctggcagccgcgctcccttctcttccttggtcaaggacccccctctctccacctcctacagtcacaaaagcaaatggacaactctggagaatgctcttatgaacacaaaacgatgaccagtcaacccagacaccctcaagacagaccgaaggtgttaagaccaccctctccaacacaaagtgttctaaactttattgtttttttcaaaatagtgttgttgttttttttttttgagacggatctccttctgtttgcccaggctggagtgcagtggcacgatcttggcttgctgcaacctccgcctcccgggttcaagtgattttcctgcctcggcctcctgagtagctgggactacaggtatgcgccatcatgccgggctaattttttgtatttttagtagagacagggtttcaccatgttggccaggctggtctccaactcctgacctcaggtgacccgcctgcctcggcctcccaaagtgctgggattacaggtgtgagccattgggcccagccggaaagagtatattcttggtcatttctgagaatttgcttttggcaaattgagctagagcctaatcatggcccacaacttggaggaaaagtctgagacggagaaacagctgtaggaggggtcaatagcccaggtgcaatcggtgcatgtggccaggatggatgagctcactctgagcaaatgtgccaaagcaaggggccctggggagctgggggaagagccaacaaaacagaagcgaaagcaggaggaaattcgccaggacggctcacacaggaacccagaggatgtagggatacagtggaaaggttgaacatacatgtaactggggccttagaaggggaaaaatgagagactagggcagagtcactatttgaaaatataatggctgaaaacgtccaaaactgacaaaagacatcaagccataaccccaagtagcaatgcgaagcccaagcaggatgaatgcaaagaaaatcacaccaaggggagagtcagcggcacaaaaaagaagagagaaagaaaatcacgccaaacatcatcatagcaaaaccactaaacaacaaagaaaaacaaaagatcttaaaaggagcctgaggaaaacaaaactgtgatccgaggagcaacaagaagactggcagctgccttttcaacagaaaccatggaagtcagaagggaatgatttgttcaaaatgcttattatttccaaaaattaagtgccaacttagaattctatgtccagcaaaaaatatccttcagggccgggtgtggtggctcacgcctgtaatcccagcactttgggaggccgaggcaggcggatcacgaggtcaggagttcaagaccggcctggccaacatggtgaaaccccgtctctactaaaaatacaaaaactagccgggcgtggtggcacatgcctgtaatcccagctactgaggaggctgaggcaggggaatcgcttgaacctgggaggcagaggttgcagcgagccgagatctcaccattgcactccaacctgggtgacagggtgaggctctgtctcacaaaaaaaaaaaaaaaaaagaattccttcagaaataaaaaggaatgatggcatgtgtgaggcaataaggtgacagtgactgcatatttaacattgtggacttgttttaaaacatttttggtatggtatttaggctatgttaacaaaatgatccatatttcaggttcacactgaaatatttacagatgaactgatataatgtctgtgctttgcttcaacgcaatagggatgagaggaaccagttcagagagcagatcagaccttaggtcagacctcctcagagatcccaagatgcaggatgctgtgacatggaggagaagtcggggaaaaaatggaagttcttgtgccttcaagttaacacgaccccagcctgcaacaaagccctaagcagataccttgaggaaagtcagcccgagactggatccctggggctgagaggtcacagagcaacactgaagcctctaggaaccatagcctgttatctccaagcctcgtctgaaagcgaaacataccagaacagtcttgggacagaggagctagggtctggatgcccccaaggacctcgtgtccagaagggaaagaaaaacatggagacctggcatattcacttccgggcgttttcaatatgacaggaggctataagaaaatttcacgactgcccacttgtggatacagccagaaatacaaagcaagagtgaaagttttgcctactcggcacctgagtagcttcttttttattcaatttttattgaggtaaatttcatgtaacataaaatgaattattttaaggtgaacaattcagtggcatttagcacatgtggtgttgtgcaaccaccatggctattaatagttccaagacattggccggctgcagtcatgcctgtaatcccagcactttgggaggccgaggcgggcggatcacgaggtcaggagatcgagaccatcctggccaacacggtgaaaccccgtctctactaaaaatacaaaaattagccgggcgtggtggtgcgcgcctgtagtcccagctactcgggaggctgaggcaggagaatggcgtgaacccgggaggcggagcttgcagtgagccgagatcacgccactgcactccagcctgggtgacagaacgagactccgtctcaaaaaaaaaaaaaaaattgttccaaaacattttcatcactgcctcgaaaaaatactatttagcagtcactccccattccccatcaccccagtccctggtaaccaccaatctgctttctgacttgagtagcttcttatctctgaacctctaccagcaatttatgaatgagagatggacaagaccatcaggtatgtggagacggtcctagagaagctgctagaaagtgacagacaaccagagtaaggggtagtggagcactgtaatgctgtggagaggagagggcagcaggaatgacaaacccaggaggcattgactcagggaaagaagaggaaggcagggtcaggtcgagatcttggccaaatccctgagctcatcaacctagggtgctccattgatgaatttatcaagagtcattggccgggagtggtggctcacgcctgtaatcacagcactttgggaggccaaggcaggtggatcatttgagattaggagttggagaccagcctggccaacatgatgaaaccccgtctctactaaaatatgcaaaaattagctgggcgtggtggtgcatgcctgtaatctcagctactcaggaggctgagacaggagaatcacttgaatccgggacgcagaggttgcagtgagctgagatcaagccactgcactccctccagcctgggcagcagagcaagacaccacctcaaaaaaaaaaaaaagccattaacaactttctttctttctttctttctttctttctttctctttctttctctctctctctctctctctctctccctctctctctctctctctctcctctctctctctctcctctctctctctctctctttctgttttttttttgagacaagttctcactctgtcctctatcacccaggctggagcacagtggcacaatcatagttcactgcaacataaaactctcgggctcaagcgatcctcctgtctcagcctcccatgtagcagggactacaggcatgtgccaccaagtccggttaatacttttaaaattttttgcagagatatggtctcactttgttacccaagctggtctcagactcctgggctgaagcaatcctcctgcctcgacctcccaaagcactgggattacagccataagccaccacatctggccccatttttctttacgatctttcaaggacttagtttgcacataggaagcagaaaggaattgtaaattcagttccatcagcatctacttggggcttacacacaagtattaattaattctcacaacagttccaacaatagtgggatcatttttacctccatgttacagatgtggaaactgaggattgcaaacttgaagcacctcgtccaaggtcattcagtaaataccttgcagagaggaggctgggccaggcctaaatccagaatcagccctcctggccctgccctgatgttcccaagacacagcagatagagttctgacatacatggaggagggaggcagcccagagggcgagctgggtcccttcaggaagggaggaaaagcagcatccagactgatccatgaaacaggtactcacagaacagccatcatgtgccaacatgtctttgggcagtcactcagacacagtggccgacctgaatgtgctgatattttgacgagaacaatacaacacaaatgaatacctacacaagggagagcagtttaggcggtgagtgctgcgagaaaggaaaaagtaggggagtgacaaagactggtccggagtatataaagagctctgacaactcaacaataaaaagacaatccaagttgaaaacaagccaaagacttattggctgataagcacatgaaaaggggttcagcatcattaattgtcagaggcagggtcacacacccactagtctcatgggctaggatactggttctcaaccaggggcaatttgccggcccccccctccccaaacaagggacatttggcaatctctggacagacatttctggttgttacaaataggtggggcacggtaggctaaaattgcccccctaggctgggcacggtggctcacatctgtaaccccagcactttgtgaggctgtggtgggcagattacctgggctcaggagttcaagaacaccctgagcaacagggtgaaaccccgtctctatgaaaaatacaaaaaaattagctgggtgtggtggcacgcgcttgtagtcccagctacttgggaggctgaggcaggagaattgcttgaacccaggaggcggaggttgcagtgagccaagatcgtgccactgcactccagcctgggtgacagagagagactctgtctaaaaaagaaaaaaacaaaaagcccctccgcaaaagatatctgtgtcataatccttggaaactgtgaatgttaccttctatgaccaaaaaagggggctttccagaagtggtgagtttaagggtattgagatgcaaagattatcctagattatcctggtggccctaaatgcaatcacatgtatgagagagaggcagaaggacattagacacacacagacgagaatgtcatgtgaagacagaacacaggtttgaagatgctggccttcaggacaggaatgatgtggccacaaaattaaggaatttggcagccaccagaaactggaagaggcaaagatcagtttgtcccctagagcctccaatgagtgtgtgtcctcctcgcctgatttcagcccagtgaaacggatttcggccttctagcctccaggactgcgagagaataactttctattattttaagccatgaagttgggggcaatttgtcacggcagcatcaattaattcacggcaccactggcatcaagtaagtggagaccagggatgctgctcatcatcctagaatgtacaggacagccccgcacaacagagaatcatttggtccaaaatgtcgacagtgccaaggtcgagagaacatgggctagggtgatgaaattttggagtctaatttcaccaagttgtggctgaacttaagaggctgacatttaaaagactgatcttgccaaacgttggcaactggaactcttatacactcctagcgggactgtaaaatggtatagccatgtcggaaaacagttcctcttttttttttttttgagatggagtttcactcgttgcccaggctggagtgcaatggcacgatctcggctcaccgcaacctccgcctcctgagttcaagcgattctcctgcgtcagcctcccgagtagctgggattacaggcatgtgccaccacgccgggctaattttgtatttttagtagagacagggtttactccatgttgttcaggctggtctcgaactcccgacctcaggtgatccgcctgcctcagcctcccaaagtgctgggattacaggggtgagccaccgcgcccggccttcctctttcttaaaaagttaagcatactgctatggtgtacatgtcccccccaaaactcgtgttgaaatttaatggccatgtgatggtgttaaggggtgggactggtaagaggcgattaatattaatattgttatcatgaaagtttggcccccgctcgctctctcacgccctcttgcccttctgccttccgccataggatgatgccgtacaaaggtcctcaccagctgccagcgccttgacattgaacttcctttctttataaaccacccagcctgcggtactctgttacagcaacagaaagtgggactaagacacataacacttccctgttatctagcaattccatatatgaaagcatatgttcacagaaagacttgtgcgagaacgttcatagcagctttattcagtcgccccaactggcagcggaccagggcataagcaacctgcggcgtctccatgcaatggaaggctgccaagcaatacgaagccatgagctactcacttcacacagcttgggtggatctcaaaacaattccacggagcgaaagccgccagacacaaagcactgcgtgccgtgcgattccacttacgtgaagttcaaaaggagatgaagctagagtgacagaaaccggaacagtggccaattatgggagacgggcattcactggaagagggtatgagggtactttctggggtggtggcaaagctctttattgggattttagctgcccaggtgtaaacctttgtcaaaactcgttaaactgtatgcctaaacttaaatgcaatttcactgcataaaatttacctcaaaaaggccaggcgcggtggctcactcctgtaatcccagcactttgggaggccgaggcaggtggatcgcctgaggacaggagttcgagaccagcctgaccaacatggagaaaccccatctctactaaaattacaaaattagccaggcgtggtggtgcctgcctgtaatcccagctactcgggaggctgacgcaggagaatcgcttgaactcaggaggcggaggttgcagtgagccgagattgcgccattgcactccggtctgggcaacaagagcaaaactccatctaaaaaaaacaaaaaaacaaaaactttacttcaaaaaaccccgcttccaaaagaataaaagaagaggccatttgaacgtggtagcctgggaagtccctttgaggagaggacatcagagcagagcctaaaggacaagctgagtgtgggagtttcctctggctgccatcacaaagcgttacaaactttgagtggctttcccagcagagatggcctctctcctggctgggggtccagcagtccgagaggaaggcccaggctgggcgggctcctgccgaggaccgagaaggcgcctccactcggggcctctgtcccagcttctgctctgctgcccacctgcgggcttccttggcttctgccacggcaggtcggcctcagcctctgtctccacacggcgctctccctctgggtgtgtccgtgtctccgtctcccctttctgtcaggacacaggtcacactgcattagggcccacccctctgcagaatgacctcatccagatctaactcatcacgtccgcaacgaccctgtttccaaataagccggttccttgtcaccaagtggagccttcaatgagttgatgccaaggcaggtctagggaactagaaatggggcaagaagcaatgtcctccagccaggtgtggtggctcacacctgtaactccagcactttgggaggccgaggtgggtggatcgcttcaggtcaggagttcgagacccctggtcaacatggcgaaaccccatctctactgaaaaatacaaaaagtagccaggcatgctggcgtgtgcctgtaatcccagctactcgggaggctgaggcaggagaatcgcttgaaccggggaggtggaggttgcagtgggccgagatcgtgccactgcactccagcctgggggacagagtgagactccatctcataaaaaagacaaaaaaaagaagcaatgtgctcctcacagtcgggttttctcccaggaccattttactcatccaacaaagaacaaagatgtcccagcaacccatctaccccaggcattgaccactcgggctacaaaggtgaaggaggagggtggggctgggcaggctgggactggctatggaccccagagagtaaagatggttttgctggcaccatacccccaactccaggacttgtccatgccctgtctacggggccaagactgaaacctgactgcctttcaccatcaagcagaagtcagctgcgcatcctgtaagagatggggaaggacccccaagaccctcccagagccccctggctcattaggaggctagagggggcctcctgcaactctgcatgcaaggtgcccagatgagacctggccagtcgagacttttacttgaaggctccccatgccttccttgggtgccatctcttctaccaatgaacgttttctgagtttctcaagccttctttcctcctgacccacgaagaaactgagggaccggggccttctggtcccccaggagactggcttgtgctgaggaggtcggccgctcactgtgcatcttctcggagatctgaagctcctcctatttccacaagaaagaaagggaagcttggcaaagacccttccatccagaatcatcaagttcgcgacgcccgtgcttctcctcagcacacagagaggagagttaccaggggcctcaagcaactccagcggaagcagtcacagtccttccaggacccaggaacgtcctctgcaaggacctacaaacccagacctcatgaaggaggagaccccagggccagccccaagcctcctgagtctaattgttgctgtgatagagaccctgcacttcgcagaatcaaaaagaatatattgtgggttttttgtttttaccacaatcaattaaaaaatgcattaaaaagtaagaactgtccaggcacagtggctcacatctgtaaccccagtacttggggaggccgtggccaggtgttcaagaccagcctgggcaacatagcaagatcccatctctacaaataataataatttttaaaaagttagccaggcatggtggcacatgctttgtactcccagctactcgggaggctgaggcaggaagatcgcttgagcccaggagttcaaggctgtagtgaactatgactgcatgcagcctgggcaacagagaccctgaagaaaaagaaagaaagaaagagagatagagagagagagagagagacagagagaaaggaagaaagagaaagagagaaagaaaaagaaagaaagagagagagagagatggaaagaaagagagaaaaagaaaaagaagaaagaaagaaagaaagaaagaaagaacttttgcctatccaaagactcaggaaaaataaaaaagaaagccagccctcataatgagataccacttcacagttacatctgttggaaaaaaaaaaaaaggataacaacaaatgttggcaaggatgtgaggcaactggaagccttctgcattgctggtgggaagatggagctgcgcggctgctgtgggaagactcctctaaacgctacacctggagtcaccacggggtccagcaattctactcctgattatagaccccaaagaattgaaaactggtgttcaaacaactggcatgtatctgagtgttcagcgcagggcttctcacaatagccaaaaggtggaaacaactcaaatctccatccactgatggacagataaacaaaatgtggtctacccatgcactggaatattagtcagccgtcaagagaatgaagtactgatacgtgctacaacattagtgaaccttgaaaacagtgaaaggagctagacacaaaagcccacatatcgtatggtcccatttatatgaaaagtccagaagaggcaaacccacggagacagaaagcagattagggaacgcctggagccgaggctaggagtgaccgtgtagtgagtctggaggtctccttctggggtgatgagaatgttagacaaccggacagaggtgatggttgaaccacactgcagatgtacttaatgcactgaattacatgcttccaaatggttaatttcacattacgtgaaattatgtgaattctacatcaatttttttaagtaagcccttgtcataaatgcgtttaatacagttgctgcctcagcatccaactttagcagttgtaccctgtcacctttgccctagataacacccctccctccctgtcatgtgattgtttgcgacatagcccacgtggtcctcgcctcactgacccaaaacccaacacatcccacggctgctgaccacgataagacctaatgctcaacaccagagtcatgtaaatcagtttcctcctcgtgcatgttttctttaaaccagccaatccacaacccccgcaggaaagcctgtgggatcacttcacaccctgtgaccttaatacaggcacagccccggaagcttccccgcccttccgttctgggcttcgctgttgcacagctgatgagctcaatcagctccctgctgcctccagacttcccctctgcctcccatcagcacacctaacatctcttcgatctgagtcatacatttctttttttttttttttttttgacacagggtcttgctctgtcacccagaatggagtgcagtggtgcaatcatgactcactgcagcctcaacctcccgggctcaagggatccccgctcccgctcagcctcctgagtagctgtgactacaggcacgcgccatcacgcccagctaattttttgatgtttttgtagataccgggtctcactatgttgcccaggctggtctcaaactcctgagctcaagcagtctgcccacctcaacctcccaaagtgctaggattacaggcgtgagcccccacgcccagcccatttctgctgtttcatgcattttcgtctgcctcctcactgtggctcccctgacacacacatccgaacctaactttcccacgggtcagggatctcctagaaactgggtatctcggctatggccactctcagtagagacatgccgagaccaaattaaaaagaaaccataatgataaaaaccacaacagccctcctgaaagcaaacggatttaactgtgataaacagcacaggacttgcagtatggattctcagtttgtgatgcaccagaggggacgcaacagtcacagggagcctggctggttgaaacacttctgtgtccagatcatgtaaaagttttgaagaagattttacggaagtatatgtttttaaaatgccatgaactcctgtgtcccctgcatctaacttagccacacagccagggtgtggtgaaatgctctcaggtccgcacttagcagccacgtagcctgcttgtgcctccgtgagactctgcttccccaaccataaagtaggcgtctgagggccaaagaacaaggctgcttaacctggtgccccagctcagttacgagcccgtgacaacagtgaaaaatcatcagcagccctttctcctcctgtagacctgcttgggccctgtagacctgcttttctgctcacgatgaacattagtaagggtaggctcgctgctgcagcaaacaaccagacatcccatgtcacagtccaatggggggtaccgggtcagaagtgcaggcttctagaatttgcagcaaaagtctgagagggggagagacagaggtattgccctgctccccggtagtcaccgctgtatcaagagcgggcgaaagactcggatttgagaggggttaagagtttacctgagcacagcattctcattggcccctgtggcttggaaacatacggggaagtttgtaactgccaccaagttctgctgttgcttaatagaaagctgaccgggtaagtgtgattttcacaaaagggtctttgatgctcccaagattttagatttggttgccatgtcctatgaaaataatctgcaagagacgcctgtgactctgactagtcatctcattgacagtggttgccctgtaatattctttgattgtcctttaacagattcttaggccatgtaaacgctggcaagatttccctggggaaactaaagaggatgattcccacacgccgcttcccctgcatcaggcactaaaaggactgcggagttcttcttttcatgcaaatgctgagaatcttggctcacctaagggaatcgctgcctccctagccaggacgctggagggactggcgttaattagccacagactgcagcgagggggacagaatgtggcaccccctgagggcccatggaaacccagagaacggtcccaataggaatggagagaatccgttgagagattgggtttgcctttttttttttttttttttttttcctccaattggtaggccctagccttatcttagagggaaagaaaatcgagctagggcagggtgaggtggctcacaccagtaatcccggcactctgggaggctgaggcaggcggatcacgaggtcaatagattgagaccatcctggtcaacatggtgaaaccccgcctgtactaaaaatacaaaaaatagccggatgtgctggtgcacgcctgtattcccagctactcgggaggctgaggcaggagaatcgcttgaacccgggaggtggaggttgcagtgggccgagatcgtgccactgcactccagtctggcgacagagtgagactccatctcaaaagaaaaaaaagaaaaagaaaatcgagctactgcacggtgcggagaaagcattcaccagaaggcagtcatttttgaaataagtatctgagacccggcctgtgccccagctcagctaggagcacatgtgaagagaccagagctggcgaggcgactccggtcctgactcccaccttcccagccgactgggaccaaaggacgccacctccctaactagtgccaggtgtctaccggactcttgccacccccatgttgtcccctgccaccacagggtcagggccagccgctatgccgctgcaaccacccggcaggggctgccaagctggagcattttcgctagcaagggtcaaggcaggtgtgggactgcagggagagggctggctcgccccactgcagggcccagtcgctaaaagaagcatggacctgctcttccaactggcccctcaccctggctctccaggctcctgtcctggctccctttcaccctcccataggtggctcctgggagcggttcctcctctgcttccagtccccagagccaaggcctcacctacacttctcctcctgaagggactccagcaacagctgcaggtcagtcagagacctctcctttaggctgtgataggactcctggaggctgatgtggaacctcttggcttcttccagctctgcctttaccttctgcaacagcaggttttgttgctgggccacatcctctgtctctaagcacgtcccctgctgtaagctctggaagcgactctccaagatgaagggcctgctggcatgaggcaggttgaccggcccgtcttccccacctggctcggggggctctgaaagcagggccttctcactgggtggctcgcagttggctgggtcgctttctgccatcagcagtaagccctcgggcctgcagccttcctccagctcctggagctgctggtgacactggtggagcctgtgctcgatctgggcgatggtggcagaggcgcgctggttcaccttctcaaaggcctgctggatgtgcggcacctggtgccggtctgctttggataccagcttgaggtagctcacagtgttgccatcccgactggccttctccactctcagctgctctgagaggtagaggatgcggtgcctgacactatcctgtaagttgtgggctaggcctccatctgcgaggctggaagggccactggggccgtcttcgctggatgacagggaccggcatgaaggcacattggaggggagggttgcgctggggctcctggtgtgttccgcctacgttgggaaacaagaaatcacaatacggtgctctgtgagccgcaaagtgtgggagaattggacacgttatgactccataaaacacttccacatatgcatggatacttacacacgcaagatttgtgcattcaagatgggcccgacacagactgaggaggtgatgctcatcttcagggcccctctcccctccttttcagcgtctgactccttgctctacatgtgtgcctcactaagacccacaggtggccagactcccttctacatctgcctgtttttgcactgcactcctattttctcttccaaaaattaccaattgtgggtctcatttataaagaactgttcttgtaaagtatggaataagcttatttccgtcaactcttacagcttgctgtattgctactcccagggagacaggaagggttaggcagagagatttgcctcctaacaggttcattcattcatccaatcattcattcaacacatactttctctgagtgcctaccacgtggtacagaagccagatacattccttgatctcatacagctgacagtctacggcagaaaattctactgtaacacaaaagaatgagtctctcacatggtgaggggattaacattgcctttgacgaagagcccagttcaaatcctggctctaccactctgagaccttgagcaagttaataaactgctctgaggctcagttttcttacctctaaaataaagatggcaagagcagcatagctggaacccagcccaccagagcaaggagctaggagagggaggtggggggcagctcaggtgcagcctctgttccgtttctacttttttgttttttgagacggagtctcactctgtcacccaggctggagtgcagtggtgcaatctcggctcactacaaccttcgcctcccgggtttaagcaattctcatggctcagcctcccgagtagctgggattacaggtgtgcatcaccacacccagctaattcgtgtattattagtagagacagggtttcaccatgttgaccaggctggtttccaactcctgacctcaagtgatcctcccgcctcggcctcccaaagagtgctgggattaccggtgtgagccactgcatctggcctatacctcaatttttaaaatgcaaagtgataccactatgtacccagtagattggtcaaactcagacagactaacaacaataagagttggcaaggatatagcgcaacaggaactctcaatcattactggcgggaagcaaatttgtactacagccaccttagaaaaccacttgacagtatcacaaagttgaagatatacctaccaaatgatccagcaactgcattcataggcgatattcccaggaggcaagtacactgatgttctcaatatccaacaactagcaacaaaccacctgcccagaaagtgtaagtaaactgtaatatatgcaacaacatactactgtacagcaatgagaatgaactacagccttgaaaaacatgaatgcatttcacaagcataatgttgaacaaaagaaaccagacagaaaatccatactatatatggttccatttacataaattccaagagcaggcaaaactaaacaatattgtgtagggatgactacacaggcaggaaagctaaagagcagcatggatgttggcaacagaaaccccaggatggtggttcccactagagcgggagaaggggattatgactggggtgactgtggaggctggggtgcctggcctgagtagtggttaaatgtgtgttcaccttatcgttacttcttaaaacatacatcaatgttttctgcacctttatatacatatgccagatttcacagttttcaaactatttaaatgttcaatataggccaggtgtggtgctcatgcctgtaatcccagcactttgggaggccgaggcgggcggaggtcaggaggtcaagaccagtctggccaacatggtgaaaccccgtctatacaaaatacaaaaaaaaaaaaaaaaatgcctggcacagtggttcacacctgtactttccagcactttgggaggccgaggcgggcgggatcacctgaggtcggggagttcaagaccagcctgaccaacacagagaaaccccatctctactagaaatacaaaattagccagcgtggtgcacacgcctgtagtcccagctactcgggaggctgaggcaggagaaccgcttgaacccggggtgcagaagttgcagtgagctgagatcgtgccactgcactccagcctgggtggtagagtgagactccgtctcaaaaaataaataaataataaataataatatgttcaattgatggatttaatggcagatttgatatggctggagagactgttggtaaattgtacagaggagctaaagaaagtatccaggccgggcgcggtggctcacacgcctgtaatcccagcattttgggaggccaaggcgggtggatcacctgacgtcaggagtttgaggctaacctgaccaacatggtgaaaccctgtctctactaaaaaatacaaaaaattaactgggcatggtggtgggcacctgtaatcccagctacttgggaggctgaggcaggagaatggcttgaacccaggaggcagaggttgcagtgagccgagatcacgccactgcactccaacctgggcaacaagagcaaaactccatcccaagaaagaaagagagagagagagagagagagagagagagaaagagaaaagaaagaaagaaaaaaaagtatccagaatgcagcacagaggcacaaaaaaatagaaaacttgaaaaatagaagacatggaaggtagcatgagtaggtctaacaaaaatccaattgtcacaccagagagagaagacagacagaatgaagcagcagcaatatatacatatttttcttcttttttttttaaattgaaatggagtcacactctgttgcctaggcggagtgccgtggcacaatctcggctcacggccgacctctgctgcccgggttcaagcacttctcgtgcctcagcctcccgagtagctgggactacaggcgcgtgccatcacagctagctaattcttttgtatttttagtagagatggggtttcatcatgttggcaagactgttctcgaactctcaacatcaggtgacccacccacctcggcctcccaaagtgctgggattacaggcatgagcactacgaccggccacagcagcaacattttaagagataactccctaagaactttccagaactgaagaaagacacaaattcacaaattcaagaagcccaataaatcctaagcagggaagacagaaataggtccacacctagacacgagattttttttttttttttttttttgaaacagtgtttcgctcttgtcgcccaggctggagtacagtggcgtgatctcggctcactgcaacctctgcctcccgggttcaagcgattctcctgcgtcagcctcccaagtagctggtactacaggcgcccgccaccatgcccagctaatttttgtatttttagtagagacagtgtttcaccatgttggccaggctggtctggaactcctgacctcaaatgattccgcccacctgggcctcccaaagtgctgggattacaagcatgagccaccgccgcggccgacacaagatgttaaaagcagccagaggaaaaaaagctgattacctttaaaaccatgacttttagactgcaggctgccttctcaatagcatcaatgcaatccagaagatagttgactgatatcttcgatacactgagagaataactgtcagagagaaaaaaataggtcacattcaaagaatcagaagtcagaatggcttcagacttcagcaacagcatggggaactagaagacaatgaagtgctggccgggcacggtggctcacacctgtaatctcagcactctgggaagcccaggcaggcggatcacttgaagtcaagagtttgagaccaggctggccaacatgaggaaactctgtctctacttaaaaatacaaaaattagccagcattgtggtgggcgcctgtaatcccagctactcgggaggctgaggcaagagaatcgcttgaacccaagaggttgcagtgagccgaggatcactcccctgtactccagcctgggcgacagagcaagactctgtcccaaaaaaaaaaaaaaaaaaaaaaaaaaaaagacaatgaagtgctgctttcgaaattctgagggaaaaatgatttcccagcctaaaattctacaccccaactgtcaactgtggggttagactaaagacatttttagacatgaaggagttcagtacaccactgacaaatgtaagaattcaacaactgtttaaaaagcaagtcttgccagggcagtggtgtgcacctgtggtcccagctactcaggatgctgaggcaggaggattacttgtgcccagcaagtagaggctgcagtgacctgtgactgtgctactgccctccaacctgggtgacagagtgagaccttgtctcaaaaaaaaaagagcggggggggggggccgggccgggcgtggtggctcacagctgtaatcccagcactttgggaagccaaggcgggtggatcacttgaggtcaggagtttgagaccatcatggtcaacactgcgaaacactgtccctactaaaaatacaaaaattagccgggcatggtggcacacacctgtaatcccagctactggggaggctgaggcaggagaattgcttgagccggggagacggaggttgcagtgagccgagactgcgccactgcactccagcctgactgacaagagtgagattgtctcaaaaaaaaaaaaaaaagtaatcactagaaaagaagctacatatgtacataacatccaaataaccaagaggagaaaaaaatgggacttgattaatcaaaacaaaaacaaaaaagaaagaaagaaagggggagaaaaaaaaacaagggctgggtgtgctggctcatgcctgtaatcccagcactttggaagccaaggtgggtggatctcttgagctcaggaggtcaagaccagcctgggcaacatggcgaaaccccgtctctattaaaaaaaaaattaatacaacaattatcctggagtggtggtgcacacctgtagtcccagctacccaggacgctgagacgggaggatcgcttgatcccggggatgtcgaggctgccatgatcgcaccactgccctccagccagggtggcagactgagaccccatctcaaaaaataaataaataaaagcaaacaagaaaaaaaaaggcttgaaacatatctgatagataaagggctaatcaacacaatatataaagaactgcaaatcagtaaactaagagcaaataacccaatataaagacattaaagggtagccacggacatctcagacgacgaaaaacaaaagacagtaaacgtataataaaacatgtaattgcaaggtgatccgggaatagtaagcgaaaagcaacaattaaatactattttctcatccaccagaacgccaaaaattaaaaagcctaacaatgtccagggctggcgagaatgtggcagaaggtgatgtcacataccctgcaagtgggaatctaaacagattcagggttttggtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatgtgccactacacccagctaatttttttgtatttagtagaaacggggtgtctccatgttaggctggtcaggaactcctgacctcaggtgatccacccaccttggcctcccaaagtgctgggattacaggagcgtgtgccactgtgcccagccactttttttttttttttagacggagtcttgctctgtcgcccaggctggagtacagtggcgccatctcagctcactgcaacctcgcttcccggattcaagtgattctcctgcctcagattcccattagctgggattacaggtgcccaccaccgcctggcatggtggctcacacctgtaatcccaacactttgggaggccgaggtgggcagatcacctgaggtcaggagttcgagaccaacctggccaacatggtgaaaacccgtctctactaaaaatacaaaaaattagccaggtgtggtggcggatgcctgtaatcccagctattcaggaggctgaggcaggagaatcgcttgaagccaggaggcagaggttgcaacgagctaagttcgagccactgcactccagcttgggcgacagggcgagactccgtctcaaaaaaaaaaaaaatgtaaacacacattccctttaacccagcagaacatgggaacccaagggcattcagcctgtggcgcgaccaggcggcctgacttgagctcacgtagaaattcggcatttttgaaccaagagacagcacttgggatccggaatgtctggacttgggcacggcgctgtggagctggcgccgttgggagccatgcgagttctgggtcggtaggtcacctcagaggtggggagaaggttctctgagaccgacatgggggctagtgctggcaccaccggacatggggcatttcagacacagggcgagcacattccctagttaccagggttcattcgagtcagtcacgtcacaggctggcaatgggctaactcctcctcaacaatcacacggggcttgcctcatagaatgttttaaaaaaggaaaggaggctggcgcaggcgccaaccgtctcagaaccctgagcactgccccacccccaccctgcccgccatagcctgggctgttgtgggggaggggtgaccatttatcacgaaacaaaaaattgcgccacagcagctccctccctcccccacctttacggttgcagctgcacgtcccacgtgcagcaccaccccctgacacgtgcggcaccaccccctgacacgtgcggcaccaccccctgacacgtgcggcaccaccccctgacacgtgcggcaccaccccctgacacgtgcggcaccacacagctagtgccggaactttttgtgcagagaaagaagaccctgcacccgcgcggagggagcccttttgagattgcaggagagaagatgagaatgggactattttcaataactgtgcacatgcaagtcacaaacattccagatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccgggtaagttctcctcattgaagtctgggtcatgcagggccacgggcccggtggcttcaggcctggtggccatgaggccgtgtggtgaagggagagccttcagaggcacaatgggctgtgtcgtaatgccctgtcttgggctgttggggcccggtcgagcaccctagatggcagcgaggcactattcccgccaacccaagggtcggtcggttggttggtcagccgcgggttctggagcccgcccctcaatttacccacggccaaagttctggaggtcgccaagatctccagttgggagacaaaggatccagactggactgaggtggcgggagaatgtcactgggatcagattgggctagctgtggttttcattttagcggggagcagggcttccctggtaagcagttgtactggatcccgagggtgaatgagcgactctaacccaggatgtgaggataaaaagcaattaaaattccagcctgggcaacatggcgaaaccccgtctcttaccaaaaaataaaaataaaaaatgagtcgggcatgggggcgcacacctgcactcccagctattcgggaggcttgcttgtgctgttgggtttgctggtatgcagttgatggtttttgcatcagtttgagggatattggtctctagttgtattgtagtatttggttttggtatcaaagtgtaatgctggcttcataggatgtttcaaagtgttccatcttaaattttttggagtggctgggtgtagtggctgccacctgtaatcccaagcactttgggaggccgaggcagacggatcgtgtgagcctagaaactagttcgagatcagcctgggcaagatggcgaacctctgtacaaaatgttacaaaaattagctgggcgtggtggcacgtgcctgtagtcccagctacgcgggaggctgagaggctcaggttacagtgaactgagattgcgccaccgcactccagcctgggcaagagcgagaccgtgcctcaaagaaaaaaaagttaaacccagctgagggcggtggctcacgcctgcagtctcagtacgtggggcctgaggagggaggatcgcttgagcccaggagttcgcattcagcttggcaaacagtgagaccctgtctctaaaaaaataaagtaaaagaaaccgggaattgagtacgaattggaacaaaaatgagctgttgaatttgctagtatgcggttgatggtttttgcatcagtataagggatattggtctacaggttttttttgttttttttttctttttttgttttgagacgaagtatcactgtcgcccaggctggagtgcagtggcacgattttggctcactacaagctccgcctcctgggttcacgccattctcctgcctcagcctccggagtagctgggactgcaggcgcccgccaccacgcctggctaattttttctgttttttagtggagacggggtttccccgtgttagccaggatggtctcgatctcctgacctcgtgatccgcccgcctcggcctcccaaagtgctgggattacaggcgtgagccaccgcgcctggcctggtctatagttttgttgtagtatttgcttttggtatcaaaagtgtaatgctggcttcataggatgagtttcaaagtgttccaccttaaattttttggagaggtcgggcgtggtggctccaacctgtaatcccaggactttgagaggccaaagcaggcggatcgtgtgagcctagaaagttcgagatcagcctgggcaagatggcaatcccctgtgcagaatgttacaaaaattagctgggcgtggtggcacgtgcctgtagtcccagctacgcgggggacagagtttgcagtgaactaagattgtgccactacggcctggggaacagaggaagcgagaccttgtagagaaaaaaaaatttttttttgaggagtttgaagaagactgttgttaatttttctttaaatgtttggcagtaattacgaatgaggcttttatttattgggcgttttttttattactgctttagtctccttactagttagttgtaggtctattcagattttcttgtcctgattaagttttgtgaggctttctgtttctaggaatttatccatttcttgtaggttagtccatttgttggcatgcagttattcatagtacactgtcactctttttatttctgtagaagcggtattaatgactccactttaacttgattgtactttttttttttaagcagggtcttgctctttcacccaggctggagtgcagtggtgcaatcatagttcactgcagcctcgaactctcgtgggctcaagcgactctccttcctctcagcctcttgagtagctggaactacaggtgcacaccaccatgccctgcccatctattaatagctagttttgttgaccttttataaagaaccagctttggctaggggaggtggctcacgcctgtaacctcagcactttaggaggccgaggcagctggatcacttgagctcaagagttcaggacaagcctgggcaacatggggaaaccccgtctctgccaaaaatacaacaattagctagacatggcgagcacctgtagtctcagctactcggaaggctgaggcggaaggattgcttgaggctgcagtgagccatgtttgtgccctacactccagcctgggtgacaaactgagaccctgtctcaaaaagaaaaaaaaattggtttcattaaattttttctattttcttagtctctgttttatttgtgctttgatcttttttatttcctttctcctgctagctttgggtttagtccttacgttgtaaagttaggttgttgatttgaagggttatttatttattattattttttgagacagagtcttgctgtgtcgcccaggctagagatggggtttctccttgttggccaggttggtttcagacccctggcctcaagtgatctgcccgcttcggctcccaaagtgctgggattacaagtgtgagccaccgcacccggccagatgtgaggggttttaaaaaatgtgtttacagctagaaatgtcccacttggcactgcttttgctacatcacataggttttggtattttgtacttctgttttcatttgtctctaagggatttttcattttctttttctttcttttttttttttttttttttttgagacggagttttgcttttgttgcccaggctggagtgcagtggcacaatctaggcttaccacaacctctgcctcccaggttcaagcaattctcctgcctcggcctcccaagtagctgggattacacgcatgcacctccacgcccagctaattttgtgtttttagtagagacggtgtttctccatgttggtcaggctggtctcaaactcccgacctcaggtgatccgcccacctcggcttcccaaagtgctgggattacaggcatgagccaccgcacccagcctctcattttctttttttaattttaatagtgttaggggtataagttgtttttgcttatgtgaataaattctatattggtgaattctgagattttagtgtacccatcacccaagcagtgtacattgtccccaatatgtagtcttttatccctcacctccttcctaccttcccccttcattctcctccccaaagtccgttatatcactccaaaacttagctccacttacaagtgaaaacatacagtatttggttttctattcctgagttacttcgcttaaaataatgacctccagctccacccaagttgctgcaaaatacattgttttttatggctgagcagtattccatgttgtatatacaccaccttctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtattttttttttttttttttgtcttgagacggagtcttgctctgtcgcccaggctggagggcagtggcgcaatgttggctcactgcaacctctgctgtccgggttcaagcgattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatctttgtttgtgtcatctgtgatgtctttcagtagtgttttgtagtttttcttgtagctgtctttcacctccttggttaagtatattcctagggtgggttttatttgttgtttttgctgtttacagctgttgtaaaagggattgagttcttgattctcaagcttggtcgttgttggtgtagtgctactgatttgtgtgcatttattttgtaacctgagactactgaatttgttcatcagatctaagagtcttttggatgagtctttaggattttgtttgtttgtgtttgtttgtttgcttgtttttgatggagtttctgtcacccaggctggagtgcagtggcatgatctcggctcgctgcaacctccacctcccgggttcaagcgattctcctgccttacccgagtagctgggactacaggtgtgtgccaccgcacccggcaaatttttgtatttttggtagagacaaagtttcaccagaccatggccaggctggtcttgaactcctaacctcaggtgatctgcccatctcggcctcccaaagtgctggaattacagatgtgagccaaccgcgcctggcctagggttttctagctgtatgatcgtatcatcagtgttacagcactagtttgacttcctcttctccaatttggatgccctttatttatttcgccattggcttttggttgtgtaagagtgtgttgcttaattttcacaaatttgtgaattttccagttttccatctattattgatttctaacctcatcccattgtggttagagaaaatacttagtgcaatatgtttttttaaatcttgttggccaggcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgctccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgcccacctcggcctcccaagatgctgggattacaggcatgagccactgtgcccggcctaagtccccattttcttttttcttttttttttttaaatgagacaattatttattttaggcagatagtcaacttaaaaatcattcagcgtgggcactcctgaaactgtcaggatcatgttggtttcctcgctgtttgccggctattggcatttgtgtcatcacacacagtccgatgaggtgacaacagaaaagcatatctcacttctatcgtaggtttccattcactttcgggttctcaatcgccctgtgtttcctcagtgatactccagactttccagatgttctggttgacccattcctctttcttttttttttgcaaaacaaagcaaaaagcaagaagagaactttacattttgtccaatagtcctaagaaattttccctgtagagaatgtcatctaagtcaaaacaagggttgaataggggcacccaaatcagttatcacttagggctgttataagaaatgccaagactgggtggcttaaacagcagatattcgtctctcactgtctggaggctacaaatccaagatcaaggtgctagcatggtcagttctggcgaggacctgctactgggctcaagagcactaccttcccccccgtatcctcacatggtcggtctccagcctcttctcataaaggcgctgatcccattcatgagggctccactctcacagcgtaatcacctcccaaaggccctgcctccaaatactgtcacactggcattaggatttcagcataggaattctggggggacacattcagtccatggcctcccgtacctgtgaatgtgatcttatttggaaatagggttttgtaggtgaaattaagttaaggatcttgagataagatcatcctggacttagggtggaccctaaatccagtgactagtgtccttataagagaaagaaaagagagattggagacacacagacaccgtggagaaacgcaggagaaaaggtcctgtgaaggcagagaggcagggacgggagtgacccagctgcaagacgaagaacacctagggccagcagtagctggagaggcaggggcgagggcgatcctcccctaggacctagggagagagcgtggccctgctgccacctggattctggatttctgttttgagccatcacgtttgtggcaactcaccctggcaggcttaggaaacgaatgcgttaacccattgcattagcgcacaaaataacaccctgactcgtttcctgcgccagcctcctaccttgccttctacttattagaccctacctctcattccccattttttaaaatttttatttatttatttatttatttatttatttatttatttatttatttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctctccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccactacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggcaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctccgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggtttttttttgggggttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagccagcaggatccaacggcaggtgtcaggacaggacccaaggctggtgcttgagtgtgggtggcagcacctgggggaaggtggtgtcacctcttgagattgacaagactgggggagaagtggactggggggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcagggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcaagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacgtgccttctgtgtgaatcagtttctcagtggtcagttcctaaataaggaaagagcttttatccaaaccagaaagagtgagccatggcccccaccagtaaacctgggaaagaataatgggctgcagaggaagcactcgctcgaggacagcacctggcctgaaaagctgtccctgagctgacgccttcctgtcagctataagcacataaagtatgtggctagaggccaggcgttgtggctcacgcttgtaatcccagcactttgggaggccaaggcaggtggatcacctgaggtcaggagttcaagaccagcctggacaacatggtgaaaccccctctctactaaaaaagacaaaaattagccagacatggtggtgcacacttacaatcccagctactcgggaggctgaggcaggagaattgtttgaacccaggaagcggaggttgcagtgagccgagatcctgccattgtacgccagcctaggagacagagcgagactctacctccaaaaaaaaatttaagaagtatgtatctagaatcaaagtgtcaaccagaaaaagatgaacctgagcttcaaaactagatttaaaattctactagatgtgtctgctgtgtcacattcctgttttggctttggttttgttttgagacagggtctcactatgttgcccaggctggtctcaaactcctggcctcaagtgatcctcacgcctggaccttccaaggtgctggggttagaattacaggcgtgagccactatacccagcccattccttatttttattgcccaaattaagtggtcagagatctttggagtcatgaccagtgtgactgaggaattgttctagaatgtgcgggatagagatggaagcactggcctggggcttggagtcctcaggacctcctcctactcctgcccttgtaagtcactgagctggtttcctggcctgtaaaatgagcatgatgatggctctgcttatttcataagatttcaaaatttattttgtaaaaatagtttctatagggtgattgcagaaaatttagaaaatgcaaagaggcaaaaatgttttacctcacttatctcactacttcgaggtaatcacagcttctcacactccagacaattttactcatttaaggtatacaattcagtggttttcattctttttatggccacatactattctattgtatggagataacacattttattcttccattcagttgatgaatgtggattagttccacttttgtctcttgtgaatagcgttctgacaattcacatattttgtgaagatgtaggtttcacaaaatatgtgaaagattttgtgtagatgtagattttcccttcttatggacatgtatactaggagtggaattgaattgctgtgtcgtaggataattctgtgtaccctttcaagagtgtggtggggggtggtgtttaaataccgttttgtgaggagtagatgcagtgacactgaaggtggctgtaaagcattactttagaggaaggcattctaacagacaagccacgcttgcttgtattcaggtgcaaaatgtcaggtttggtgagaccacaggacacataagcgcacggtggcaacaaatggagcaacagattccatgattaaaatgtgcaatttctaaacacaggaaagagcccccaaagcctcacttcagtcccctagaaggttctaggcagaaacagtagggcagatcaaaggaatgagagcataggagccatgatcacccagcgaggggagtgagccctgttgccagcttggcctggctgtggcttctgagtaaacacgtgtgtttgttaactgttaagaacctggtaatgaatactccctggaagatgccatggaccctggcctctggccagtcccctcgcccttgagtcctcctaacatcttattgctctgattacttcccatggagaagccagccagcagggactcgggaaccatgtgtcccaaaacctggcttgaatccccaaatctgcttcttgactgtggggccttgggtagctgtagaaggggatgatggtgctgatgacggggacagcatgtatcccacaaagctgtggtcaggatgttagtgccatcttttcgaaacacccatgcaggcccaccctgcatacctggcagcttcctactccccagcacccccagcacgccctcggctggccagccccatcggcccctcagcacgatccttccccgccttgctgggattatgttggggctggcagcaaccaacccgcctgcccgcttctgggccaggcagccctgtgcaacccgagctgctcccctgtccccgctgtcccaccgccctccctggacgcctgctacccaccatcaaacaccgcctcgtgccggccccgcgcaccctcccgccccgtcggccccacgcttcaggcgctacctggagggcatggctcctacccgtgggcactcgccttcacccttggagcccggccttccccgggcagccgggagaggttctaccacttcacgaggcctcctcgccctgccaggccgaggtcagggttagagaagctgggtcgttagattcgggagagctggaatgatctgatgtgtcattccgtacttgggtgaggaagccgagcacgcagagttaccgctcagggcaggacctgggctgcacctggtatcagggcccacgtgagagataccctccctccctaagtgtgtacctgacgctagttctgggtctaacggcaacattctagttctaggtctagttctaggtctagttgtagagggtctcctggatgatacaagtgagtgtccactggcaaggctcctccccaggtaaacttgtgacagagttctccagcaaagaaacaccagtcccccagacacgggaggtcgagccgccgccactaccaagggaggtgcagagggactgggggcttctcgagtctcagcttcaaccaaggccaaccagatggccccattccgggtttcagggtcccattcttcccacatcactgcccacgattcacgtgtgaaatgtggcgaggctggaaattcatcactttgggaatctgtaactggcacaataaaatgtgtttgattgtcagaactgtcagccctgcaagtacaaggagtaagggaactttgaggcctttcctggaagcaccctggttctgttactgtggcttgagctgagagttagggagcctgagcccattgtgtcttcatggtacatagtcagggccactaaggatcatcccataccacagccctcatagccatccgtgaccaccatgacaagtcaggtgcagcaaggacttgagctccctggtgcttgtttcagttggcccatcatcccaagcaaccgaagtgacagctagattaattgtgaagccactgcaggccatggatggctcatgccccacttcccactgggaaaatgctcaaccctgcactccagcccaaaggcaggaccagaccaatcgccagattccatgtgcataggccttttcttccagaaccttacccagggccagttctggattagtcaggaaccagttaggagacaaaaatacatacctagtatctcaagaaagggaagtgaaagcgtatttacttggggtttgagggctgaaagtgcaaaagggatactgaagtaacagagttggtgaaggaagaagctacaacccccagagcagggaggcaaaaataaagatgttggggtgaccaggagtctagtactgagcctgggagcatggaaggcctagggctctggacctcgaggaggggctgctgcagtgcgtcacagaaggaggaagccacatcatctgctaagaacggggcaggaggaagtgtctttggcatcgtcttccaggtcactcattctgtgttcaggggcatcaatttgctgttgagtccattggatgagattttcattgcaatgactaggcttatgtacgtgctgcttttcaaatctccctggatttctaactcttctcttttgtatctctttctttctacccttaggttgttgtgtcagagagactattagagatctgagaagtcagtagctttacatcacaataatgcaaacatctatgagaactgctctgtgatctgctgagaattctaagctggtcagtctgtgcttgcagagttcagccgatcaggcccgagaggagaacagcggttctcattttaccctcctctgtttttcgcgtgatgacccgaggcctgggagatactgagccagacttgcctccgactccttccttccacatgcatcacactccacacaccacacaccacacaccacggggaatctccaaagggcaggagtgggagggagtgcagcaaagccgagaaagggctcaggctctggagcccaacttcatgagtcacatttccctcctgtttttgtctgaaaatgggggtaacactggcaccgacatcctagggctgctgtgaggagggggtggatgctcccagccattgctgacaatgatgtgattggggatctttgaggattccaccccggaaccctgacaggtccagccttactctttgacctgcccactgactctactctccatgacggtggccagtgctgtcatcgtgaggctgtgggccccacttcagctttacctccaaaagtcctgtggcagaatcctggggtgacgtgtcccctctatggaaggtaggttgtctctgccaggatcccagcagtatgaccgcactaaggaggcaaggtgatctatcagccagggctcacagagacctgagccttttccccgtgcctgtgggcaggcaggccgtgctggagggtgctcagggcacctgctgggaggcaggcagattccttctcacctgctcacgcagacccaggctgacatggacctgctatccctgagctccctgtgctgaggcagcgctcacctcatctttcctttatcccggaagtaaccttgcaaaaacactgggttgagctgaggggttccgttcggcacactcacctgaaggcacaaggcctcctgacccagaggccatcaagaccaagtgcagcaagctgcttctgcacggccccagcgtcaggtcctgcttaggcctgtttttttttggttgtttctatttttttctctgtatttagagatggggtctcacctcgttgcccaggctggtctccagtgatcctcctgcctcagcctccaaaaattctgggattacaggtgtgatccaccgagtcccgacccctctgtgttttcatttgctctttgtttccacccagggacggccctcactcacctgtggcccaggtatgcttgaaatgacacaactacaagttgtatcattgctcctttccttgccttctcccaaactccactaaggatgcatggaggacaggcgatggggtctaacaggtgtgatgctcatcccagcctagttagcactggctcatgtaacctagaccacaggccatagctggacaggggtggcggggcgacctgcccagcttgggtcaatcaggaatttgtaacgggcactcagaaatctcacctacagctgggtgaggtggctcacgcctgtaatcccaagactttgggaggccaaggtgggcagatcacgaggtcaggagttcgagaccagcctggccaacatggtgaaaccacgtctactaaaaatacagaaattagccgggcatggtggaacgtgcctgtaatctcagctacccagggggctgaggcaggagaatctggcttgaacctgggaggtggaggtttgagtgagccaagatcacaccactgcactccagcctgggaccacagagcaagactcttctgtctcagaaaaaagaaaaacaacaaagaaattgcacctacagtctcctcactctctagtgggcattaaaatgaactttctgtagccagtttgggcagagggaggatacagcctaatcctgggtgccctagaaggtcgtgcaggctgttctcggcacaaggacaccttcctggggagccagagggctgaaatccctcccgtgtcctcgcctccagccgagtacctgccccgagagcagagtgcctcttgctgatccgcacataagcctgcaggggtgggtgggggccctggagcccagacaggcaccaaggaatcttgcagccctacaaggtgaggacgggggaactgtcggagttccacctgttggctcctctccctcctgaccttcccacgggaatccttccaaccgttggctcaaagaaattgaagtgggtttctccattgctaccctcgccatctaggactccactgtccttttttttttttttttctgagatggagtttcgctcttattgccgaggctggagtgcaatggcacaatcttggcccaccgcaacctctgcctcccgggtttgagcgattctcctgcctcagcctcccgagtagctgggatcacaggcatgtgccaccatgcctggcttattttgtatttttagtagagacagggtttctccatgtgggtcaggctggtctcaaactcctgacttcaggtgatctgcccgcctcagcctcccaatgtgctggaattacaggtgtgagccaccacgcccggcttttttttttttttaattgagacaggttcttgctctgttgcccagactggaatgcagtggcatgatcaacactcactgcagcctcgaactcctgggctccagagatgctcttgcctcagcttcccaatcagctgggactacaggcacacgccaccatgcctggataactttttttttcttttgtagagatggggccttgttaggttgcccagactggtcttaaactgctggagccaagtgatcctcctgccctaaccctaacccaaagtgctgggattacaggcaggagccaacgtgcttggccagactccatggtctcttacctggaccaggacgatggccccacccaggccctcagaactgtgggatgaggtgtttgcttctggctcacccacgagaaagaaactcccggaaggaagggaccgtgtctggagcgctccaactccaggccccagactgcaggtatcccttgccaacagagctgaggccagcaggggaaaccattcctgccacctggactaagaatgagatcctcttgaaaaaaaacaatgttaagaagtgggctcttcccatcacgccaccagagtcccaggaagccagggatgtgggtgtctaatggtccgggacaagatgatgggaaacttcacatggagaagaaaatgcccaagaatgactgaaactgtctgcaaggtcctgctaagggagctggcaggtgcaccaggtatggcgagatgcaaagcaaggagcccactgcatcgttccctggaaggacaagtgcagaggagaccacagatgcctgcgcatttagcaggagtatggcagtgccatcatgggggaaaggctgtgtgacaaatggtatggaggagactgactgtcccttagaaaatgggaaaggagccaggcgcggtggctcacgcctgtcatcccagcactgtgggaggccgaggcggggggatcacttgaggtcaggagttcaggaccagcttggccaacacggtgaaaccccgtctccactaaaaatacaaaaagtagccaggcatgctggcgtgcgcctttagtcccagctactcggtaggctgaggtgggagaattgcttaaacccaggaggtgaatgttgcagtgagccgagatcgcgccactacactccagcctgggtgacagagtgagactctttcaaaaaaaaaaaaaaaaaaagaacagaacaaacataagaaaatgaaacatcagtgttcttgaacccagcaatcctaccccttgataacctcagcaagagcaattctcccttctcgctaaggccacattccgtgccatggccttcgtggcatggtttgtggcacaccaggagctgaagccctggggttgcatcactcagggtgggaatgatcaaatgtgttgcatccaagctctgaaatcctctgcaggagcacaggagtcaactgtacgtctccagggccacagacaaagagctgagaaaccctgttgaatgacggaagcagtcagcagaataggaatgcagcacagggacagttacggtgggcaaaaccatacacacaaaaaatccacaggtgcagggcagtggctcacgcctgtcatccaagcactttgggaggccgagacgggcagatcgcttgaagccagaaataggagaccaacctgggcaacagggtgagacctcgtctctacaaaaaaataaaattagctggcgtggtggcacatgcctgtagtcctagttactccagaagctgaggtgggaggatcacttgagtctgggacatcaaggctgccgtgagctatgatcacaccactgcactccagcctgggtgacaaagcgaggccctgtctcagaaaactaaaatacaattgaacaaacacattccaaatgacaccacattttaaatgacccctttgggagggaggggaacaggactaggaaacagggaagaaggaaaaagcgaaaagctacagttctcccatctaattttcagctacctaaaaagctgttagcccaaaaggtgctggtgaggctgtgggtaaacgctgagggtacaatgcgagggacggacagtatcaaaggtagggtctttaggggaggcaattccctagtgtctcttacaattttaaatgcaggccacacaaggtgggacacatctgtaaaaccagcactttgagaggccaaggagggaggacttgagcccaggggttcaagaccagcctgggcaacacagtgagaccctgtctgtacaaaaagaagttttctaaaaaagccagggatggtggcacacacttgtggtcccagcagctcaggaggctgaaacaggaagatcacttgagcccaggaggttgaggcggtggtgagctgtgatcgagccactccactccagcctgagcgacagactgagatcctgtctcaaaaaaaaaaaatttttttttttaatgtacatatatctcgacccagcaattccacttacaggtaattattctagagagagatggatgcacgttcaaggctgtgttcatagtaaatgcaaggtagaaataataatgctttaaaagtacatcaaatggaggcccggtgcagtggcacatgcctgtaatcccaggtactcgggaggctgaggcaggagaatcacttgagcccaggaggtggaggttgtggtgagctgagatcacgccattgcactccagcctgggcaacatgagtgaaactctctgtctcaaaaaaagaaaaaaaaaagtttaaagtacatcaggccgggcgcggtggctcatgcctgtaatcccagcactttgggaggccgaggctggtgcatcactgaggtcaggaatttgagaccagcctgaccaacccaggtgagaggtgagaggatcccttcagcctgggaggcaaaggttgcaatgagccgagatggtgccattgcactcagcctgggcgacaagagtgagactctatctcaaaaacaaaaaagttgaaattataaaaaagctaaaacaaacaaaacaaaatcactacaaaacgtgtagcataacggtttttttttgtttttgtttttcagacggagtctcactgtgtcacccaggctggagtgcagtggtgcgatctcggcttgctgcaaccttcacctcccgggttcaagcgattcttctgcctcagcctcccgagtagctgggactacaggcacacgccaccacgcccagctaatttttgtatttttagtagaaacgaggtttcaccatattagccaggctggtctcgaactcctgacctcgtgatccacgcgcctcagcctcccaaagtgctgggattacaggcgtgagccaccgcgcccggccgcataatgggtcttaacttggctaattatgtgggtgattgcacagaaaaatagtataaataacttcatgcttttttatacatgggataacttgcttcaagttgtttcaaaaacgttttttttttttttttttttgagacagaatcttgctctgtcacccaggctggagtgccgtggtgcgatctcggctcagtgcaacctctgcctcctgggttcaagcgattctcctgcctcagcctcctgagtagttgggattataggcgagggcgccaccacgcccggctaattttatatttttattagagacagagtttcactatgttggtcaggctggtctcaaactcctgacctcaaacgatccacccgcctcggcctcccgaagtgctgggatcacaggcgtgagccaccgcgcccggcctcaaacacctctcaatgattcgcttgagtatgtgtaaagtgatgcacaggccaccctgaagaccttggtggtttctattgaaactacacatcaagccgggcgcggcggccggtgcgcggtgcccagaatcccagcactttgtgaggctggggtggatcacctgagcccaggaatcccagaccaacctgggcgaaaaagcgagaccccatctctacaaaaagtaaaaaattagccggacatggtggtggcgtgcgcctgtagtcccagctacacggaaggctgaggctggaggttgaagccctcgctggggtggagaggtcaaggctgtagtgagccctcatcgcgccactgcactccagactgggcgcagagtgagaccctgactcaaaaagaaagaaaaggaaagaaagaaggaaagaaaggaagaaagaaagagaattacaaataaagctacacatccacttctacacttctgcgtggactcgagcgttcaagatgggcgtggcaacccgatgacaggaaaccctacacgggcgtgctcccagcaggctcctccgtgagggccaccagccacgggaaaccacgaccttgtccctcaccagcaaaagctcagcctgcggctccgcgagcgtggaccgttccgtggccatgagcgggaagaaccacgggcccccgccaggggctgggatggatctcgcgggcgggaggcggagggtactcggcccaccccagcggaggacaccgcgtgggtccgctgagataacgctccgcggtgatggactccatgactcccggagcagagccctggctgcgctgcaccgcgggagggaggggctgcgtctactgcggggccacgagagggaggggccggggccggggccggggccggggccggggccggggccggggccggggccggggcgggacaggaacccgcgcaagcgcggaaatgcccacggccgcgccctcccgcgcgcaccgcggcgacacccgggccgccctcggaaggcacggacgtcgcgccgcgctcccggggcgcttcacttgcgcccacggccgacgccccggcagcggcgggcaggtgccacgacctctggacgtttgtcgccccttctcgggaatggaacgcttagagaagcgcaggtccacacccaaaacacaaggcggcactgttgcgtgtgcaccggcgactctgcggccagcgccctgggtctcgccccgggaacgcctaggagcctgagagcgccgcgccacacccggcagggccgcagcggcgcgcacgcgacggggtgtcgtccactgggcagcaggagcgtcagtcaagggcgaggggcgggaattccgtgcaatctgagcatggtcattggcgaggacaggcgaagaggaggacggataggcggggctgggcggggcttcccgtgggcgcctggagcttaccaggagcgaccgaagcggaggcggggagcgaggcagctgtgggccccggcgggcggagactagggctgtccctccacgccccgcccccgcctcggcaccgccttccgcgcctgcgagtcctgggccggccctgcggggcatgcgccgagtccccttcctttgcagaccggtggtcactgtcttcccccggggacgaggcggacaggcgtcgcctgagatcagggcccgggaagccccgtgagccgctctcgcctcggcgccgtcgaggggccgccccgcccttcccactccactgtgctgcgaaagtgcctcggggcgcgtctggggggtcgtggggaagcagggccgcgcccacccggcagcgtccagggagaggtgggcagagcggggcgggcggccgtcttgggggaagtggcgtctggaggtgtctgtgcaccattccgcggtggcgcgcggtggggtaacaaagtcttccccgtcccttgacagcggcggccgccggggagggaatcctgctctgctgcgggcggtcgtgggctggggcgcttcctggcctgactgtctcctgggggaggtaggaaaggcgagccccgcagagaaggcggtggcttccctcgacgtgggtgccaacaggagccatccctccagccggtcttcccgcgggagggtgcctgggaacacccgcagggctggttccagcacccatgggaccgctgggtccagcccagtgtttccggggaagccccgccttacccgccaaccttcccgcaccgggagggttcccagctgctggtgatgctgctcaggcgactccccgcagcgccaccacccacccccccgggagccggccgctgggtttggcccgtccgccctggttcctctttgctgggctctgaggcccggcgggacttctccgcggcggctctggcgacccagcatctctttgccctggggtcagacgggctcccaaggaattgcatcccggtggagaagacgcttccttccctctcccttcctctcctccgcccccttttgctctcttgtccttgcactttgccttgtccgtgtgtccggctctgtgtgtgtgtgactgacgcgagcccttagtcacctcttgctactattttctccccttattatcacttgtctcttgactgtgtggtttgcgggttgtgcttggtcacagaggggattttagttttcgtgtcatcagaatctccaggctttcctgatggcttctgggggttcttgtcggtttgtttccttctggctcacgccgtgtcttgccccctggacgctgggcaccagttccgactactgggtaacagacgacttcacgtttcggtccttccccacctagcactcgtctcacccccccagcactcgtgtcacccccccaagggttctgagggacaggctctgggagggctctcggggagccaggactgtggctcagggtccctctcaggctgcggtcaggtgtccactggggcccagccatcctatctgactgggtggggagccctcgtgatgactctccctctggaggctgtggcaggaggcctcagttcctccccaccgggcctcctccccagggctgctgggcttcccccggacctgcaatccagtcgaaccagcaggagagggcgccccagacccggccacagtctcttcatggcctggtctcctaagtgactcgcctcgcctccgctgtggtttttattggtctcacaggtccaccctggcgcgtgctggagagggcgccacgctcagggtggaggctgttcctgagtgctgcgagtcagaagcacccttgcacgtgtagacctgcgtcggctgctggagatcccgagcgggccgcctcaggaacatgtccttggtgtcagcgggagcagcaggccacctcctggggctgacactggccggggcctgcatttctgagggcggggcgtgctttgacatcctgaaagggttgcaaaacccatcacagagaaccccaagaagggagactctgccaccgagaccccgtgtgccccgcagggtctgcgccgtgtgctctctggctcttcatggaagcctttcccagccctggtcggggagccccggtccaacatccccaggagccggtgggaagcccgttctggtctgcatggcatgagtgccccacgccagcccgggtggcaggatgtgccccccacctccaatgcccccctcccaggggctcattcctgcccctgtcccctctctgccccaggtggggcagcctctctctgcagacaggggaggcctctcctccccgcatgcagccctgaaggggaggggccggggcagggagggggtgtgccgcgtcgtcatggtgaaggcagagcagctccttttctccgtgatgtgtcaggttgccggatactgggctccggtccctggcctggagggtgggatgtggagggccaggtgggtcctggaaggagctttccactggggccccaggaagaccttggtgtctcgtttccctggagacgtgccccatccttcccactgggactggcaagtgacttgctgatgacgctctccgtggctctgagtttgtcacagaggttccgtgggcggtgagtgcttttcctgttggcccgcgccgcctctgggcaatgcgggggcccttggtgacagctcctggccccttccaaagccgcctggcccttcttgaacccgacgagagcaggttgccgggccttccctgaggaatgtgttcctggcaagtggggacagcccctcccccagggtgtcgggtacagggtcctggggtgcttcaggacacggtcaggcccaccgaccccccacactcctgggccacctgcctgctggctgtcctctgtgaccctctctcccctgagccgaggtgccggcccgatcccgcgggaagaacagcgaggagggccggctctccctgctatgggggcctcgggggcctggacggggactgtgtcctccctccccgggctgcccggcgccctcgctcagggagtgctctcctagcgacctgttcggcagatgggcacagccacgacagcagccagaccctgtcccggcccatgcacccacctggacggatcggcgccctcctggacttactggctccattgagggtcccaaaggagctgccccagagcaccctaggggcgtccggacccctcggcccgcagcagctaccagcagcccaggcaggacccaggggcttccgggcacagaggcgccgctccctggctcgtgagcccagggcctctccagccgtcccctgttgggggcctccactcctgctctggatcaaggtcctgcccctagggagagctggtgccttcgggggagcgggccctggttgcagttggagagtgggtccagggatggtgttctgcttggctgccgccctgcctcctgggggcctccccagatcccccccggctgctgtcagctggggctgaggggtcctgtggcctagggggcatcctggttcgggagtgccctgccctggacaccgtgtccaggaaggatacatgctcaccctttgttgggggccaggcacagggtgagggggcactcggccccaccacccgtgtctctgggaaccctggctgggtacggcccctcttccgagagatcctgcccgggactggtgccgcctgcctcgggcctgccccccacacagttggggaccctggcggggcacctcctgccagccacctgctgctgtcctagcctcagccgggccctgcaagctgtccatgtgcctgggacacccggtccctctgcaaatgtttgcaaacacccctgcccccacaggcatgtctgggggcctctctgggcctttgtgtgccgagttgggcgtgggtggcggcgggggtctttccatagtcacctacttcctgtcctcctcggccccaggtccagcggtgccctgtctgctcggtttccagcctgagccctttcctgagctggcccggtcccctaagcttctgcagcaggttcccaggtccaccccgagggactcctggccagtgttcccaacagtgtctgagtgctggcctcagtccctggccatggattttggggaaccccgctctgaggggccgttgcttccctttcctctccaggtcccctcccagtttcctcggagagcggggatggggctgttgggaggcggaagggagggttggggtgcagaggtgtggcttgggggagggaaggtcaactgggctaccgcccctccctgccctccctggactcagtccagacacaacctgcgggttggaggcctgtgcaccctttatctcctcctagtagcctggcgggtcctcctgggtcttcctcagtgtgtgtgagtccccaggccataggacccggcagggtgggggcccgtgctctgctcttgtttttgctcctacttgcccgcccttcccggggggggccctggccaggaccgtgccagtctctttccctgctgcctgcctgcctgcctgggtggcctccagctcaccaccctgtgaggcctgtggcctcccgccagggctgtcctcaggggcccggatccccctagtttatcttctgcccttgccgccccacatgtgtccctccctgcagcctggggacgatcggcaggtttgggggaccggtgcccttggttcacctagcccagccctagggcggtggccctgccaggcatggggcttgagaggggatgtgatggagcagacacagggagggggcaggagaccctgggtgactcgggacaggagggagtgccccagaggttcagaatcctgggcacacagtgggctgagcggacaagtcgcagcctcagggggacctcccgtcctcccaactggcactgcatctttctgggcctggctctgctgcctcacagccccgttcagctggtggcttttagaggcttccagagtgtgcttggcccctttacctctatgccattgggcccagggggagcagtagagtggctgcggctgggggtgggacttcccctttctgtgtcttgcttgccccgtgtctcccagtgagtggccgccctgagcctggggccagcagcccagccccagtgagaaataaaagtagccatcctgcctgaactgccgctgccttttctactttgccctctcaacaggggtcaaggagggtacgcgtggtgttgaggtctcagaaggtctgggtttgacgtgtgccatggctgcaggctacggcctggtcgtgtcagacgctgtggagctgagggaggatgtggcgagaaagctgagcgttgcccccgagagccttgcttcctggcccttgtctgcagatgtctgaggtggtggtgtccttgtcaggggtttgatcgagggccaaagcctttggcccagggagcaggcagctttgggtgctgcagttgggatgtcccgatagcatgcaggcagcaccaggagccaggacgacttgggatgttatgtgtttgggggcaatctttacagtgggagacacataggttggtgtgggaatccacggcaggggtaccaatgaggggatattcagcagggggcccagggtacctgggattggcaccttgaatgcatccacctcctgccacctgttaactaaagggccctgaggcccagagcctgggggagggggcctcatcccagtcccttgtttgggggaatggtggcatggtggcatgttcaagttacctggcagatggccagggcctgctgtgatttttttttttttttttttttgagacagagtctcgctctgtcgcccaggctggagggcagtggcgcgatctcggctcactgcaagctctgtctcctgggttcgcgccattctcctgcctcagcctcccgagtagctgggactacaggcgcccgccaccacacctggctaattttttgtatttttagtagagacggggtttcaccgtgttagccaggatggtcttgatctcctgaccttgtgatctgcctgcctcggcctcccgaagtgctgggattacaggcgtgagccaccacacccggccgggcctgctgttgattatctggccacctccaccagggagccttcctgacaccaccctacccagtaatgggctctcctgcccagctctttgcctccttgctgcctgggctccattccaggttgctacatgttcctctccttacgttggcttgaactcagggaggcagaggaagcaaagatagatggtgccttctggagtcagggtggggtgaagcaggagccctggagggaggtgacctgtgctcagcccatgctttgatctgctcattggcacccctgtcaggttggccttgactggtcccccaaccccaacaaagctacagccacgcaaaggagaatggaagcaaaactttattcctcttggctggagaagagaactagtgggtggttgtgtacaggacccccatccctcacccctcccagaaccaaagaagacaagcagcgccaccaaatggctccctctgcccaagtgaaagccgagaggtcagcggctggctggggaggcaggtgagcgcagcacggcacagggcaggggcggctgcagtgacaggcgggcggccagggcggcctgggccggggttgaggggaagagggcggggctgcttgggtagcggggcaggcttgggggctgccggctggcacgggccccagactcagggcaccacaacgcggtaggggctgcctgggatgtgctcgtccccccatttgaccaccagtgtgtactcccccttgtccttgagcaggtaggacacgctgtagagccggctgcccacgtgcttcaccaggatctcctcgcagggggtccttgggccatgaacccccaccagcagcatgttgttgcctgaggcaagaggggtcctcagtcccaggtcccagcccccttcctcccgctggtgtcctgctctcctctcctgtccctaagccagttctggggtgacagttctctcttcctaaagagctgccagcacctccccaacccaggccagcttagcagattccagctcctccctggtctttgtttgaggggtccaggaggtggcagggaggtggctctagaagtgaaagccacgccccaaaggcggtccctgctctcccagacactggccatcctgtgatttctggcctcattttggtgggaaggtgggccgggggcccgggttgcccacctgctttgctgcagtctactgtgaagctgctcttctggcctacgtaggccttgctcagccccaggcccttggccaccaccttgctggcgtcagcaggcccaggacccggggccccatgctggggggcacaggtggccttggtcagagagtctacaaacactgatgatgtctcgtggaggctgtggttgctgacgagacgggggcctgcaaggcagagtgggtggggctaagaggtggctgtggtgccgggcgttgggcagatgccaatagcttggccccaggctcacctgtgactttggccttgaaggggctgcccccaatgtggtaggggccgccgtacttgatggagatgaggtagctgccaggtgccatgggggtataggtgacgcggtagccctcagggcactcctggcaatccatcttcaccttggaggggccgtcaatggtcaccgacagggcaccagctcccgcattgctcgtgttcacgacgaactcagctgggttccctgggagcacaggaggtcaggcagagccagactggcctgcctccctgtcctcggccacccagcacaggcttgtcacctccaggtgcctcctgttgtcaccaagagcttggaggcaagggcctagcagctgtgtgcacacgtgcagccgcaccgacagacttacctgtgacaccgccttccagacctgctccgtaagcagacaccaagcctgggtcccctccatgcccaggctccccaactcggatcttgaaggggcttccagggatgtgggtgccgttgaacttgacgtcaatcaggtaaacgccattctcccgagggatgaagcgcacagcatacttatctgaggagcagggagtcatgctgtgggcctggggcccctcctcaaaccagcagatggtgtctgtgaggaacagcctcaaccctggccctccccattttgccggtccatcagtgtgagcccagccacgctgggcacctgcaccccgcagcagacctcctgagggccgaaggtttagacactcaagctgcccaccgtcagggtgcattgggacggaaatcttttacaagccaaacccaggccttgctgcctcctaagaaaggttaccgtgaacaccatatcccctgcatgttaacaggctcagagacgggcaggaacttgcttcaggtcatgcagctgggaagggcaggactaggccgtgaaatgaagcccactgggctcctcctacccacaaggctgccccaggcctgtgcacaagtaccatggccgtggctgaagggccgggcagcactgaggctggactttgagtctttccctgtggagatggcatggtactgcagggtagaaggccttcctaatagctgtgggtggcgagccacatccccagcggcttgggtcaccaattgggaaagggttgcctggcttagggggcccaggagttggggccccgtcttggctgcttacagaagcggtaccttccttttgtactctcagcctgcttccagccagcagggcagggcggccgggcagggacagggcctcaccttggtcaatttctgtgacatagcactcctccagggctcctgaggggctgtgcaccttggcatcgatcgcccccttggccccgttcaggctgactgcaaaagaggctggctggttgacctttagccctgactcctggaagcacagcagacatggttagatgggggtgcttgagccagggcaagggaggacggaaaggccccaggagcaagaggcccgcgggtcgcacttacccatctggcgtccaacttggtttaaagagggagagccactgatttgcaaggggcagcaagccacaggcgcacatccccgcccctgcccccacactctgccgtcgcacacacccaggtggcaggaagggagggctgccccaccctgtgggcagcacccagccttggcaggctgtccctctttaaaccgcagccctggtgctcaaggggcacaggcttctgttcaaagcctttagacctgagacacgagaaaaactccacgtggtgggcaggatatttcctgccgaccccaagcgtgggctgcacccggccagagcagaggcctggaacccagagctgggccaggggggtcactgaacacagggccaaggcctggtctctgcggtggctctggtctgtccgggcccaggagccccaggtgggcggtttctctcggtgcctcacctgaaggctagaaacagtgaggcggcgggcgtcgccagacggagaagccacaggcaccacgaaggggctgtcgggaatgtgttcctcgttgaacttgactgagacttcgtagtcacctgggcagggaaagagtgtaagaccggctcatcagcctttgggcctcccacctcccacgaacagcctgggtggccctgtgacctcaaagtgaagagtgagtgccaggcagggctatctgtgccagccctgggtccaatacccacactcaggccccacctcctccaaccccagccgggttcccagtacctggctcctggaccacataagccacaccacaggagccgtccttgcggtcctcaaaagagatctcagccttgctggggccctcgacagcaatggccaggcctccagcaccagcttcccgggtccagatactgaattcggctgtgggagaacagtttgtcctcactgaaggctgcttcaccagcctcggccccctccaggcatagccaaggtagacatgcctgccggctctttcctccacccccaaccccaccctggccaacgcaggagagcgagcactcggggtgtgagcaggcctacctggcactccagcttcagctctctccaggccagggcccccagctcggaccttgtgggctcccccttcccctaggggccccacggtgaactggaaggggctcccaggcacgtgctggcccttgtacttcacgctgactgtgtgtgtgcccatctcagcgggaacaaagcggatgcagtaggtgtggttctccccttccacgatctcggcctcatgggtcttgcccgatgggctggtcacctgggctgtcatatcctggatgctaatttctgcagggtggggatgggctagtgagcagcagccctgggctccacccctcctcttggggctgcttgagccccaggacccctccccaggcttcccacagcccctaccagggattttcaggctgaggtcacaatgactaccaacgttggccactgaaggagcccgacgcctgcgggtgatgctctctttcacccggccctcgcctgtcaccttcacagagaaggggctgcctgcaggaagaaagcacggcccacgcccctccagtcacatactgcctgtgggccctggtgtagtgaggggggctgccgaggcactgctgcactcaccaggcacgtgctggtcggcaaacttgatgttgatgatgtagttgcctggctctgtggggcagtaggtgaccctgcacgtcccgtcctccaggtcctctgtgttgatgtccaccttgctggggccctcaatggacaggctgagcccaccatagcctaggggatggatacccctgagcctcggtgctatgcacagtgctcccgccccagctggtgggcagccactgcctacctgcatcgcgggtatcaatgataaactctgcaggctcaaaggtgtggccttcgtgaaggccctgaccagagacccgaacacgactggcatccccaatttccgactggctgatcaccaccgggatggggctgctggccacgtgctggccatttttcttcacatgcaccaggtgctcccccgtctccttgggcacgaatgaaatccctggacacagggcatggctgtcagtcagggagggcatggctccccacaggctgcctcctttctgaaccccctggacccttcagccgcttacccacgtggccattacgcagccgcttcagcaaacagggctcctcccggcccgagggcgggaccacagtggccgtcagcaggctgagatccgtctctgagatgttgatggggatgtcggcagcagagccgacctttaggtgggacatacgcatggagtcgtcacctggtggggacaggccagccatcagtgtgcgtccagccatgggagaccatgcccaccctgccacccgtttctgtcactgctcccagtgccacccacctgtgacccgagcagtgaaggggctgcctgggacgtgctgttcattgtacttgactagaatgctgtagtcccccggcagcacaggcaggtaggacacgctgcatgtcccatcctggttgtcagtgcagctgatttctgctttggacgggccctcaatggccagagacaggccccctggagagagccgtgggtgagcatgggaactatgctggggacactccagttggcctgcactgaggagctccgatggccagggcagcagggcagggagccccattcaggagtatctcctgagtccagcccttaccccggtgagggcatcccgggcacagagcaggtcaagaccagagctattgctcaccctctcctgcatccttggtgttgacggtgaaggtggcaggcttgttcactactccatgggtgaggccaggcccataggcagtgacatggccacagttgacgtaatccacatagaactgcaaggggcttcctgaggcaggaagaagggccttgtggaatggcagcctcgtgtgtcccccagccccatctctctgtgaggtggtggcggtggagtgggcagaggcagggcaggcccacctgggatgtgcatgttgtcatagcggatgtccatctcgtgcaggccagcctcgctgggtgcataccgcacggtcacggtgccgtctttgttgtcagtgatggtgggctgcgccaccttgcctgagggcatccgaacctcccctgtggggcagtggggctgaggtcagggcagctcattggcacagtctggcctccttggctcccgagctccttcccaagtccccactcacctgtgatctcgcccttcttgatggtgaaggggatgacaaggtcaaagggcctcaggctggtcacatccagcccattgacacccaccaggggcctctccggggcctgcagtggagacacagggcatgggtgagggacagtgggaggatctggggtccctcctcacacatggtaaactaggggctcacagaacacccagctggctagccccagtgtccctagctggccaggccgtacccaagtctgctggccgccctgggcgtaggtgtactgtggggccagctgctgagaccgtagagggggctgcaccgagggctggtccccagccagagcctgcagggcaaagcagagagctgctggagagtctgttgtcacagaggggccccaggggaacaggccgggacctgccagacacccctgctgacctaccccccacccctcctcaccgtcacttggaaggggctgttgggcacgtgctcgccaccaaagcgcacacagatgacgtatttgcccggctggggggccgtgtagaagatgtcgaaagtgccgtcctcattctccaccacgtccacatccacctctgagccatcaggcgtgcacacggtgcacgtcactttgcctttgcctgccgccttagtgtccacagtgatcaccgtctcctccccaatctgaatggtggggccgatgccagcacctggtggggcagggtgggtccccaaaggggggccagcgtgtgagctcgggttcaggttgttcccgtccgcctgccgcccacacaggcctctcattgccaccaccaagcacagccaggccgccaggcctcctgccccgccctgcccctccaagctgggatggcgagtggtttctcagaaggcaggaaggtttctcctgaccacctcaagtgcccatgtgggagaggcccgacagtagcacccaggtgcctgggaggaaaaggaagggcccactccagcctaagtgttgacagccactcccttgcctactcagcctcgtccagcaccatggcccacactgctgaacgccagcatctggctgggcacacggctgcctgcgcccttctggcctggccccggcccccattgctgtgtgtggacgcggtgaggcggagtcctgctgcagcgtggggggatgtgacacttgcctccccaccccccaggcctgatggtgaaaccggagtttcctgacaactgagaaggctcgcggtgaaaagcagcccggtgcagacaggagtgggagcggggaagcgggaggcagcggggttagcacccgagtagcgcagcgcagcaggcttggcagagcggggatagcacccagggagacagggaacaggaggcccaagctacagccaccactgctgggttgcgagggcagagcagctgagcaggctccagggccccagagtgcccgaggaaaggggagagacagtgacgttatgatctgggtctccgccgtggaggcttggggggctgtgggctgtgaggcctggcagtgagagtgccccctgcagcctggcctcctgccagggaagcagccaggagcacgaaacctacttgaaggccaagctcgaggggccctgccaccaagtcccactatcggccgagggctcctgctgcactaggctccatgctggcctgccgcggccaggcagctctcccaggctccagacctggctgccggctgcccacgctgccctgggaggcttcactcatgtgcaccccatgccatctagttagtggcttgggccccaacctcacaggtacccgactgcccccactttccctgcccggctcccagccaaccgcaggtctcagccactccatcctcaaagtatgcctcctaatttggctctcactgaagccccgtggccgtcaagcttgccagagagcaacttcagcgcccccttccccaccccgggctccctgtctccattctgcaaacagtagccagggaaactgaggttactgagtcttgctcccaccctcaaagcccccaaggccctgcaatcagtactccccagcctcccccgccctgcgcacacacgcctgtcacacacacatcggatcctacggcctgctctataaagccatctcgctcctgccgcaaaactctagccaccctctcaccctttccttagccacctcgcccaagtgccaggcctgtagcctctcatcagcatccctgggtgtccctggctggggcaggtgaccctccatgcctgttggggaatgtctgaataacgtcactgctgggggataggggaagggggaaggagggagacgggccacagaatgcactttggggctctgaggctgggccgggccccgccatgctggccgcccaagcagtcgacactggcgctactgcactaccagccagccccacccgctcatgcacctcccccggcccgggacgcagaggcccctggaaggtggggatgggggtctgtggatctggccagggctggggctcccattgagttggggagaccccttgttccctcagcccacgcaggagcccttgtgcctccctgggtgccaagatcccgagaccccaaagtccccagtggggtgcctctcaggatgcacctcaccccaaagctctcagctgcaacccgagttctcagatggggaaataaaggcccagagaggggaagagctggagcggtcatgctcagctccggaagcctccctgggccctcgccctccagcccacggcctcatcttctgcaccccacccaactctgtccctgcctagagctgcagctggaactgtcctgggaatcggccccaagaggaaaggaagctgcccctctgggcaggaggggcattgggagtggccccagcaagcagcttacctagcccgtgacctccgattgacactgaggtgagagggcagagagcaaggagaaaggtcaggtgagtcactcaagggggcggcccccactcccacacgccgccccaagcagcgagcccttgcacacaggcacaacccaagccccgtgccgagcgccgcagcggccaacagcgggcgggctcacctgtgacagtgcacttgctggcgtccccggtgggcacggcacgcacgcggtacggggagaaggggatctcgtcaccaccgtacttgatgaggatggtgtagcgacctgtcacgtctggcacgtaggccactgtatacgtgccgtcatggttgtcttggatgtgtgtcttcttcggcttgccttcgggatcctgtgtggcagaggcaggggaggcagttggcccaagcccgagtagccccgggcctgcctcaggcgctcccagagtgcccagcgctgctgctacagggacagtctctgggcctcaggcatcttaactgctatggcccaaaagggctgcctgcacctggcagagtccagaatggagactaaaacatcccacacttcccacatgacaacaggcgcggccagccagcttggcacccatcctcagccccagggcctggccagcactaggaggagctcaccggggtgatctcaagcttctatcctatacctgccccatgagaatattacaggtggggaaactgaggcacagaaggctttggtgacgtgctcaaagttagcagcaagtgcacgtctggggaagcctgtgcctgtcaccaccatcctaaggtagtcacaaccttagcaaaccaaagacaggggccctgtccttccctgccctccttggtgcagctccgcagggagatcagacaccagccacccgcagcccacactccagccgcccaggcccccctgcctcccctgcctgtgcccggagctcaccgtgatctggacagccagcaggccctccccggcgtcctttgcatcgatggtgaactccacgggcaggctggcaggcacgccagtggtgttgagcccggggccactggccttcaccttgctggcatcatgagtaggcagcaccttgaccttgaaggggctgtgagggattggtgttgtgagcagtcagacaggttctcagcatccagcctgggccactccccacaggcagcaggccctgcctcttacctccggggtacctcttcatctccatacagtactgagatgctgtagggcccttctcggctgggcacataattgacggtctgggtgccatcagcgttgtctaccacgtccactggctccaccaggcctggccccagccccagggacagagcatcagctagtctcctgggcctccattcctaccccaccacactggacggccaggacccagccccaggcctagacctcgctttatcctcatccacccgaccctgggaatggccttgaccccctctggcacgaaagacacccatctgggtgccagctgggacccttgcctgcctgccttcctgccacatctgctcagtgaccagtcccatctgctctacctcctccaagtcccccacctggctgcactgtcacctgaggctcttccaaaaacacctacacacttgcaccacctctgcactctggtcctcactttgggcctccagtttcctttcccggccctcaaacaggacactgccctcctgacccctggctccaggcatgcaaacactcacctttgggcccttgcactttgacctgcaatggggccacaccagccttgcttgtgtccacctggaaggactgagggaggttggcacgaaccatgcctgggctcaggccgggcccagagcacttgaccttggacgcatctgtcacatcatgcacagggaccttgaaaggactgcctgagggttggggcaaagggatggcggctgtatgagacagggtggggacgagcagacagtcccagccctgccctggccgccacctcctcacctggcacttgatggccaccataggtgacgttgaggctgtaggtgccagcctcataagggatgtactcgaccgagcagctgccgtccttgttatccatgcaggacatcttggcctcggaggggccctctacagccaggcccaggccgcccgtgccagctcccctggtccaaacagacagccggtcattcctggggttcccaggcccaccagccacacgggctcctgggggctcccttacctggtctccacagtgaacttgttgggcttgttggtggtgccactttggatgcctggcccgtggacacgcacccgggaggggtcgcagccctcggtcacgggcacctggaaggggctgctgggcacgggactgccgtcataggtcacgtccacggagtgcagtcctggaggagtgcaggccaggtcaggaggagcccgggccaccccacccaccccgtctgccagcctgtgggagtccccagcacgcaccctcctcgtaaggcgtgtactccactttgtacatgccatcgccacggtcctgaacgtaggtctccgtcaggttgcctgaggggttggccacacgggccttgacgtgcggccctccggtctgtgtcagagcccgggcgtccacactgaactcagtggtggcctcacggaagacacctgcaaaggcacagagaggaggcttggggctcgggggttctggtccctgtcccccgtcacataccccacggcagggcaactcaccctggccctcaataccaggcccatagcactggacaccggaagtgtccaccgcaggttccacctgcagcttgctggggaagttgggcacgggctggccgccgtacttgatggtgacggtgtaggccccggggcagaggggaatgtaggtaatggtgtgcgtgccatcaccgtggtcctggatgtacacctcggccggaagccccgcctccgagcagatctcaatggtcagctccgcgctgcccgcgctcgagcagtccacttggaattggcccacctccccagcggtggcccgctccagcccggggcctgagcacttgactttggatgcgtcaaagcagggaaccacgtgggccttgaatggggagccagggatgtgggtgtcagcgaagaggatgttgatgttgtagtccccgggctcggtgggcacgtaggacacggaacatgtgccatccccattgtccaagcactcgagctgcgcctcacaggggccctccaccgtcaggcccaggccacctgtgccggcgcccttggtgtcgatggtgaagcgggcgggggagcccgcactgcctccctgcagccccggcccaaacgccttcacctgagggaagaaggggtcaggagccaaggccacactatgccccgatcccagacctcctgcttgactttccacctgcctccccttgccctggcttcctgccctcaccaaacagggacacgggcgggcccaggctgcctgccagatgggccatccatcagtcataaggacaaaaaggagggcagggcgcggtcactcacgcctgtaatctcagccctttgggaggccaaggtgggtggatcacctgaggtcaggagtttgagaacagcctggccaacatggtgaaatctcgtctctactaaaattaccaaaattagctgggcatggtggcgggcacctgtaatcccagctacttgggaggctgaggcaggagtattgcttgaagccaggaggcggagggtgccgtgagccaatatcgcgccactgcactccagcctgggcgacagagtgagactctttctcaaaaaaaaaaaaaaaaaaaaaaaaaaaaaaaaagaaagaaaaaaaaaaaaaagaaattcttcaaccctgatgactttttgtgggtttctatttccctcctcccctttactctcacttaaacagggtcaaggttgacagtctgtctcaggaaaaaaaaaaaaaaaaaaggatttagggcaggtctggagaagatggggtacctttggggccctcagagagcacagtgggttctacccttagggcctcccataccccaattaccttgctaggcttggtgggggccacagcttccagaggaaaggggctgccaggcacgggcacgccgtcataggtcacctccacctcatagggcccttcctcacggggcaggaagcgcaccacactgttgtcagcccccaggcctggctccaccttgcagggcaccgctgcacccgaggggcccacaatcttggatgccactttgccttgaccaccagcaccctttgatttgactgtgaactcctggtctttgccaacgtccacctctgtggaaacgatgaaaggaaggagagagacatgacacccagctcagccaatccctggatgtgacaaaggcctttgcgacaagggccccaactacttactctctcccaggccagacaccttgatcttgctgaggtccaggcttggagatactgccactgagaaagggctcttagggatgggatcccctccataagtgacattgacgcctactggaccctgggaagggtgcagaagggaagggggtatttagagacaccagaattgctccccaaccccctcctggacctccatgcctgtcctctcccaggtaaggaatgagagtgggcagaaagtccctcggagctgtcccctaggctgctgcatgaggaggctggggactcggtgactgtagtggagggtgtggctacctgctggacaggcgtgtacttgactgtgtaggtgttgtcatggtggtcgatgatgtccacatctcgcactgcatcccccttggtgagtcctgagaactggacgtccagcttgcctttgccagcagctttggcatttactgtgaagtgggtgggcttgccaagctcgacacctgaggaacacacagggaccatgtaggggcaccctgccccaagccctcctacccttgatgccccgcaacctgccatggggtacctgtcctcaccagtgcgactgaggccagggccctcggccttcaccttactggcgtcatgagagggctccaccttgactcggatggggctggtgggcgtggcctgcaggcagtgggaggagaaggccttagaggagggcagacgtcatccgcaatgacatcttagcggccaggagcgcagcacccacctggtcagcaaagaggaccataatggtgtagctgccagccccccggggcgtgtacttgaccgtgaaggtgtcattgtcattgcggatgatgtcgaagtcgatgtcagcttcggcggggcctaccactccaggggcacacttgatgccgatgctgacgtcccctgcggcggggagaggagcggaggctgagacctcgcagggacaccccagccacctgccctcccacccacagccaggccttaccctggccagcctcggcgcagtccacagtgaagtaggtgggctcgtgggccttgagccctgtcttggctactccggggccgtatactttgaccttgttggggtggctgccagctcccacattcacctgcagggcacaggggcaagggcaagggcatgagcagcctggaggagactcagaagctccctcagctacactggcaggcacacaaaatggtccagctgccttgggaagagtctggcagttcctcagttgaccacagagggactgtgtgatgctccggttcactccgaggcaactacccaagagaaatgaaagcaaatgtccacgcaaacacctggactcactgttaacagcactgttcatgatcaccaaaggcaagctcatcctcaatatctgttagcaagtgaacggaaaaatggaatgtggtctggccacacaatggagtattatgcggccataaaaataaatgaagcggccggacgtggtggctcatgcctgtaatcccagcactttggaaggccaaggtgggcggaccacctggggtcaggcggttgagaccagtctgaccaacatggagaaaccccgtctctactaaaaatacaaaattagctgggaatggtggcgtatgcctgcaatcccagctactcaggaggctgaggcaggagagaattgcttgaatctggcaggcagaggttgcagtgagctgagatcacgtcattgcactccagcctggcaataagagcaaaactccggctcaaaaaaaaaaaaccaggatgggcgcggtggctcatgcctgtcatcccagcactttgggaggccgaggtgggcagatcacaaggtcaggagatcgacaccatcctggctaacacagtgaaaccttgtctctactaaaaatacaaaaaattagccgggggggtggcgggcgcctgtagtcccagctacccgggaggctgaggcaagacaatggtgtgaacctgggagaaagagcctgcagtgagccgagatcgcgccattgcactccagcctgggcgacagtgtgagactccatctcaaataaataaataaataaacaaaataattataaaggaacaaagtgccaagacatgccaaacatgaacgaaaacacggaaaacttcgtggtgagcgaaagaagccagacacaaaaggccacatggcacacagttccatctatagaacatgtccaggataggcaaagccacagcagaaagcaggttagtggtcaccaggagctgtgggacaggggagtcaggatggtgtgccacaaccacttgaaatggacgaatcgtgtgctacgtgaatgctatcgagatggactaaaggccggtggaggttggctcaccctgaaggggctgttggggatgctgacgcctccccaggacaccatggctgtgtgcttcaccggcttcctgggcacgtaggagcagctgtaagtgccattgccgttgtccttgaccaacgcctccacagggcagccttcattgtcctgtcaggcagataggagcaggtggcctgctggtcagtgcccaggcctgggtgcccacacctgccctgcccccaacacccgtgggtgctctacctggacttggacccgaagtggggccttgccaccgtgcttggcatccactgtgaactctgctggcttgttgacggccacacctgtcttctccaatccaggcccacgtgccttcacctagcgggagaccacccagctgtcagggggccaggtccaggctgccagagctacaacccaggcagggtggccagggacacagagtgccatccccaccagaccccaagcaggagcagcagggcgagacttaggccatcacagcctgctctttaccctgtctgggtggaagtcctggggcgcgtcacggatgtcagccatgaaggggctgaggcggatgtcttcgctgttgcacagcacgtgaacggcatactcgccagcctcctgcggccagtagcgcacatcacaggagccgtcgcccttgtcgtcacattcgatcttagcctgcgatggcccttccaccgagaagcctgacaacagccaccagtcccctcagtgccctggagcctcagggtgggccgtccttgccatcgtctgtccccaggtgcccatgctgcagcctccaacttacccagcgtgcccacgtcgtccccgatagcctccaccacaaagtctgctgacttgccaacgacgccgccctccagcccagggccccaggcccgtaccttctgattgccacactcggtgcccaccttcacttcgaagggactgcaaatgcgagagccacacagggaacaccgaggatcaccacatgagccagcgtgggccccactgtggcggccaggcaggaagagcccatgtggcccctcatcatcaggtggggaggcagaaggaagagaagaggcagagtgtgcagagctgggagagggatgcctgggggcctcacctgcgcccgatgttctgaccaccccacgtgatggtgacgatataggttccagggaccatggggtaatactcgaagccatacacgccatcccccaggtccttctgcttcacgcgctcctctccctctgccaagacaaggagggcctcaggcctgcccagcagtgaacccgggggctgccgccacccatcctggcctggctccaggccaacttactggggcccttcacggtgaccttcagctccccactgccagcgccctttgtgtacaccttgaagtcagctgtctccttcacccgcacacccttgggctggaggccccggccaaccgcccggcaggcactcgggttacaggctgcaggcagaggggccagctgagcaccagcagctcggctgggcgacccctcccttgcctcccacagggccgggctgtcaggattggtgggtccctcagagcttggctggagggggacatgcaagacagaactggaagggactgtgaccccaggaactgtggcctgggccaggacatggcaggcctcctcccacctgctccacaccagcccagagccccccagcctcccccttccaagaagaagacagatccaagtaccgttgaccctgtgggcagagcagagagcagcaggtttctagacagctggagcgagctcttccgaaggtgaaagcgtgaggagagagatggagaggggcgaggagaggagaggaggaagggccccagcaggggaggaaaaacagcatgtgcccagacagtagaagctcaaagagtaggggccccggggcgggctgcagcgggactggcccagggggtccccctcctgtgggaggcccagactgcagtgccacagcagagggcagtcagggccgggcctaccttggccaacagtgacagtgtaggggctgcgagggatgggcacgccggcaaacgtgacgtgcacggtgtggacgccctccatggtgggctggtagctgcagcggtatgtgctgtcgccccgggcctccagctgaggctctaccgtgcccttctgtcccatggggtcctggatcacaacctcgacctcgcccgtgccagctcctgccacgaggcacctgctcagctcccaggccccagtgcggctctccccacagaccagctgggccttggcagcctcccctcacctgccgtaaagatctcaaagtaggtggtcttgttggcgatgttgccactgggctccaggccgggaccttgggctgtcactttgctggcgtcaccctgtgacttatccacgtacacctcgaaggggctcttggcgatgtgctggccagcaaagagcacagtaacctgtccccagaagggtgggccgtgagggtagggctgggggcctccagccactgcctgaggtcacaagcctcccccctggccaagggctcaccttatgagtccccgtcacctcggggacgtaccagacggagaaggtgcggttcttgtcgttattggcggtcacttttgcctgcagtgggaaggagcctgtgagcctttgctaagagcagccccactgaaagggagcgctgcggggcctctgctgccagcagctggccctacctcctcctggtgtccggccgggtcctccacgtacaccagcacctctccctggccagcacttctggtctccacagtgaactctgcccgcttcttcaccatgttgcctgtgggctcgatgcctggcaggggaaggcgagccaaccacgggccagctgttaaggccacagcctcacccctccacccttcagccctccctgctggcccctaagtcaggcacattccaaactgggcaagttcattcagtgtgagctgtggcacagagcctggcctcgggacccagctgtgctctcgctgctgggacaggcccagcctgttttctggaacattcattctcaccgcactgggcccttgttcctgtgtgagccttgactgggttttaggtccctgttactgagacctggttcatctccatttataataaagaccgctggatgctacctccccgaggaccccacgcagcaggcttctgtgactggaggaacctattagcattctcttgtcgttttcactagtcccaaaaacccactcttgtctgactcttgggtggcttgatcacctagccgccatgtaacccaagacccctggggaccgccacgtttagatgggacactgtcttatggggaagacgttggcacacgggtgcacccctggtggggctccctcacctggcccgtaggcacgggctttcttcgggttcagtttgggccgcaagggagcccctggcttcagcttggccttggggaactgggacaggtaggtcatgacagagtgctcgtccacgttggggtccacaatctcctcgggggtgatcacctgtcacaggcagaaaacaggagccatcgggcctccgagtctctcccaactgccgatccggtcccctacagctgtagccaggccgggcgggtgtacctgggggatgcccagccagtcatccgcctgctgcatggcctctcgcgcattggtaacgggcttgctggcgtcccaagagtcccagtcaggacacaggcctgtggcgcaagggaggctgtgagtctgggggccgcagaaccccctcaagggccacccatgggtgaccccagcccagtctctcctgcctctgcgccccctcacccggggcacagctgtccaccagggcgcccagggcccggccgctctgccagtcccggctgaagttggtgatgggcagctgcggcagcttgttctggatccagcccaggagcctctgcttgggggtctgcttcttggcctcctcatcctcctcctcgtcccacatgggcatggagatggagtagtgcaggatcagggtccagatgaggcccaggatcagcttcaggttcccgtccacgatggccttgctgtctgtgagtagaagagtggccacgctgggcacacggctgtgcgggaggggccgatcccaggctttggggtcagggtctggcagcacggggtagcaggggccaaggaggaggtagacaccccctcttggccagtggtaggatgtggatgaggccctctctgcccagggtcccagggggtgttcagaggtgaaggagactttggggtgagggcagatacacacagacacacacacacgatgccagcagggtatgattactgccagaagccctgggcccagaggaagggcagagggcagacccagcctgcagatgggcagctctggagaacagctggacagtgtccacagctgccagagcaggggtccgccacacacctcaggggcctatggggaaccaggaggaggaggctgactccagctggcccagaatccagggcccatgacctggagtggggctggggctgaggaagaggaaggtgggtggccctgggtggttgggaaatacaactgttgttccagggtgggtggggtgaggcaggggaagtgggggagttgggcaaacgccctttgggtgagggattgtgacccccgccaccacccccacttcctctaccacctcgaagactcaagcttggagttgggaggccacaggcctagccaggggaggggcccagagcccaaaggaaccagcagttgggccacatggccctgactcactggggcccatcgggagatgccggggtggcagcaggagacactgggaacccccttgccacccactgcctgacccacttgccacctaacgggcctctgggcctcggcaggctcgccacaggggaagtggttagggcgggtccctgacaccccccatcaccatggcaaccctgctgggctctgggccccacccaaggctacttctgggtctcaggctcaaggcaggatggctcatctttagaagccctgtcagcctcccccataatcagacaaaatacttctctggtgagtcaactagggggcgggcctatgaggaggggctgggctgtccatggcagctgcttcccagcccagcaggcagcacctggagggccaggtgagccgctcagagtggcctccccagttcccaggttggtcctggccccacgaggctgcctttcactctccccaaatggcagcagggagggggactcggagaggaccaagggtgcagggccagggaacaaggccagccagggcttcccatcaggcccccaccccagtccagcctcagacccctcaacgacccccacacggggagcaaccaggcccaccaggtccatgttaggccagcctactccgtccccatccccctcccaaaagagagagggaaggaccagggcccagggctgggagactgtctggctggatggccccgccccatcccacccccctttccccagcccctgggccagccaacccctccctcccctaatcactgctgctttccaacatttttttgccttatatggcaaagctctgggaactaggcctgctccagccagctcacaaggaggaggggagctgggaggagggaggagaccccccctaaagagctggggtgtggcccgcctccccacatccggtcgccccccctaccatccaggactgagatgactcagcttggctagactgaggctgggacttgtgggggtgggcctgcccctcgcctcaactggcattccaaagaaagaactttggttcttgggatctgccctctgagtggctgggggaacccaagtcttggtccctcactttcttgggttcagcaagggccattccagggctgcagggtaactggaaggcctctcaattctgaagaagagaagactcatcatccctctcctctccctgttccacatcacccccgagtcacccattctggggcctgccctctcatgcagcccctatcttgagaacgaattgggctgctgcagcaggcctggtcaatgccagcctctccagtccagtgacacagacactgggctggcacaatgcacgctggagcatctaccaaccaactcctgcgtgctacacgcagaaaagcaaggcctacatggaagcaagagtttggcccaagatgaagagaaaagttggcgtccaagtagtctacaagccaggtctctcagtcaaccacgcccaactcaccccgggtgcagttttgctaactatgcttctttctggcccccaggttgcctgtgtgtgtgtgggggggtagatctaaactggtggttggagccatctccgatgggcgacccatcctccagggacacaaagagcccagagccccagacaatgggacgcacgagctccaacccacacttcagaaccaacgggcctctgaaggccagagggccctctctaaacagctgtggggggagagcccgggcctcctcctcctcggggacggggcgcagggccaggagcctgcccagtgcccgaccccccaggcccactcccaccgcgagcacagccgcggaggcgcggcctgcggaggatgtgagttcagcctgggcgccggccagccggggcgcagcgggcgggggcgcgtagcggttcgcacgcccggccggccagccagccagcccgcgcgcctttgttctgcaggcccgcgtggagcagagcagccggaggcctcgggagttgcgctgcggcccggaagggggtggtttggaggggtccgcccggggagatggaaggacgcacggagtccccgcccccgcccgcccggcgcttcggggcgtccctcaccgatggacaccagtttgatgctctcgcggtccaggaactcgagcgccaccgacacgttctcaagctgcatttggcggaaagtgggccgctggttgtgcttgcggtgcatcttcttctggctgagcacctccaacagcgcgataagccgcagcccgtcgctcaggtccgtctgcaggttggcgatgcgcttgctcacgcacttcaggtgctcgttgcaccagcgcgtgaaagtgttctgctggatcttcttccacggcgcgtcctccgccaggtccttctcggtggccggcatctcggcgtcccgcgtgtcgacgccgccgcccggagccgcgcctgctgcgctctggcccgcccgagagtgggagctactcattttgaggcgcgagaagccgggggggcggtgctgcagcctcggcgaggggacggccctttaattaaagtcgcaggcacctaggcgcgcgggaggcgaggcagggagcagaggttgcgctgcggagagagcgagccctttaaatgcgggaggagggcggggccagagggcgggcctcctgcggggaggggccgtggggtggggcttcgagggcgcgcctgccccaccccgccccgcccgttggaatgcccccactaggcccccgggttcggctgatcagacgcgaaacccgggctccagggtgggtcgctgggcagtggggtgggcaaggatgctcccagccccgcagcctcgcgttggcgctgcaggaaacgcgccctagagcgaggaaaggctgagcagtgtctggcgcgggactgcttggcctgcagccggcgcgccttacaagggactttccttccccagggcccctgcggggggtggggtggctctcttccctaagtcacttgggctctgccccgtccctgcacatccctaccccccgccgtcatcccccttccccgggcccccagggcctagggttccccggcggcatccccgtccgccggcccggcagcggcgggaaggggccaaccctaagagcgaacccctggagagcggcagccccggaccaggcactgccgagggcgctttgtgtgctcatcacctgggaagcggctgcagggcaaggcctgcgcctacgcggtccccgcagaccccctgccacgggcccgccttcccagtccgtagggccctcgcccgcgcacctgtgcccgctgcttcccaccgcctccctctctgcttccctccacccgggaggatatggggcactgggccaggaggccgccggcactccaggagcaagcagccttcgaaggggtccgggcatgcccacgggcacgccagtgggcgcgggcagagggcgccgtgcgatgcatgcagagacgtgtgcccgcctaacccttcatgccagttcacccggggcactggggggagctgaagcggggggtcctctcctgtcggaaagtcccctcagcccagcgtggccagggcagggggcaaacacgggagtggcattccagacccagaggggcctgctcagaggttcccataagacttgtcaggctctgagcacctgggtctgggtgggcttcaggtgtggtggcaggtgcagaggaggcctgaggacagggatcaggggcctggggggttgtgtccccagagctgtgggggctcttcactcaaaattttctggtagataactctggagatggtgcagtggctgctgtgccgagatgtagactgggaccaggggacggctggggacgctcactgctactatcttcagtcagaagccagcctgcctatggcttcctccccattgtgcactcccctccctctcagtcctcggtacctcccctctccagaatgtttcctcctctgagtgttttttttttttttctaggaaggcaggtatctgtccctcctgttcaattctagtaataattaatttatctgctaaagaccagtgagagatggaggccctgggttggccagcacgtcatgcccaaatatggttgactctcctgtagccctgggtgtctacatgacacgtggtggggctgtgatccgcccagcacattcacttcggggcagcctgtggccccactggtttttcccactagtagtggtgttagggggtgcaaatggcattttccagtactgaggccaacccctgtatattgtcccctctcctgaccactttgagacacacctgcaccaagtgcgcctgggcgtctgggagctggggtggaggtgggagggagggctgggaagggggaacccatacagacccctccctgcacgggccccattcaagacgggcttgaagttgtccttctggtccccctgccccactggaaagcaagttcccaggcacggaattccatcaataattgactctctctccactaagggccattgagctgggttgtctgggttcattccttaatcttcagagctcagggaaactgagtcagagtgaccagtggtcaattccagcagaaagagtgtcaggaggtgggtgccgtgtcttccagccctagcttttccctatttagaggaaacaaggaatgggcgtgtagagggttcttgtccctagaacatagtatcaaccgccagatgtcgcccgatcccaaagccaccagatcgggcagtcctgggaagccaaaatccagctctttcatattttcccttatttggagtagattcttggatgttaggcacaccccgcccaccacaccacccctggccctcagaccccaggccagaccctcccactgggaggtatagcccaagcccaggagctgttcagctgggatccctaaggagctgtttccaggcctgcgtagccagggggcgcaggagggaaggaagccgcagactggcaaggtgagaagagacctgtgctggcaagtccaggtgcggcaggtgaggtcgcccattcccaagctcccaccttgacggtgcactcggagcacttacaaatgggtctgccagtggattttaacctattttgcctggccccaggtggcacgggaatctggggacattgttggttatatcctggctggcagtgcgcatccaactcagagccaacctggcatagggcccagggcccaaccaaggaacctggcctggtctcatcctcaccatggcccccatggagtagagcagccccagaaccagctcccctgtgcccaaagcagctggtgccctgtggactcgagccagcaagggacacgctgtccccctcccagtgggcacactggctgagaagtgtccttccaggtggccactcgccctgagtccacacaagttcctggtgtcagggcccttctctctcaggcatgcagtggtccgttcatgggcaagtgcccagacaccctctctctctcggggaccccccatggcctcaggctcccacattcgtgggcacagacatggctcgtgggtcaactagggaagctattctctggacactcactcccagatgccaggggagcctccatcggctcacgcatcccagctgaacctggcccggacctgggcgcgagctggcgcctgcgttttccggcctctctgcccgccttctccaaccccgcccccggccgacgaggagcgcggcgaccctacggcgcgaagccgggccgcggagacctcacctgctgttcctgagagcgaccggtgaccgatgaccgcggggtggcgcccggatcgccttcgcgcccgcgcccgcgccaggcgcctcggggattctgtcggcgtccgctgcgcgcgacgcgcctccacgcgaatgggccgccgccgcccgccttcttgttggccgcacccccgccccgcgcccgccccgcgcccggcccggcccggcgagaaagccttaattggtaaaattgcccaggagcccgggacgggtgcgtggggggcgggggtgcgggggcacgccgtgagctccagcgacccgccgccgggcgacgccgccccccgagatgagctcaccgccggcgagggccgccaggccctgggggagggagggcttcgtgggggagtcgcctccagcgcccacagggactgcagggctcgtgtctaggcccaatcacaaggatcctgcgtgtctgagtctgggggagccaagcgcaccccaggtggaaaggccgaggcccaaggccaccttctccaaggagccacccacagtcacagcccctggtgtctgtcccaagccgggattgtttcctggggtgggggcaacaggtcgttgcaggtgttggctgggcgcctacgtcaggcagggccccgggacgggactgcagggctccgagccctgggatgaacctgactgccatggatcaggcgctgccaggtctggcctggggtgggcagcagaaacaggatcgctcagggggacgagaaagttaagtttgtttagtattaagaagattctgatcttaaagaaaacattggccgggcatggtggctcatgcctataatcctagcactgtgggaagctgaggcaggtggattaattgagcccgggagtttgagaccaacctgggcaacacagcaagacactatctctaccaaaaatataaaaattagctgggcgtggtgacgtgcaccggtagtctcagctgctcaggagacagatgggaggatcgtttaagcccgggagtttgaggctgcagtgagctataatttcaccactacactccagcctgggtcacacagtgaaaccctgtcactaaacataaaaaaaaaggccaggtgcggtggttcatgcctgtaatcccagcactttgggaggccgaagtgggtggatcacgaggtcaggagttcaagaacagcctggccaagatggtgaaaccccgtctctactaaaaatataaaaactagccgggcgcagtggcaggcgcctgtaatcccagctactcgggaggctgaggcgggaaaatcgcgtgaacccgggcggcagaggttgcagtgagccgagatcacgtcactgcactccaacctgggtgatagagactccgtctcaaaaaaaaaaaaaaaaaaaggccgggcgtggtggatcccagcactttgggaggctgaggcaggtggatcacgaggtcaggagtttgagaccagcctggtcaacacagtgaaacccggtctctactaaaaatacaaaaattagctgggcgtggtggcaggcgcctgtaatcccagctactcgggaggctgagacaggagaatcgcgtgaacctgggaggcggaggttgcagtgagctgagattgcgccactgcactccagcctgggtgatagagctagactgtgtcttggaaaaaaataataaatataaaaataaaaatacaaataaaaaaataacgttaacagctcagtgaacaatcatctacttgtcatagacactgaggaatgtttccatgttgatattttttcctcgtaactcaatcatgttgggattgtaagttatacagcatatactgcttgcaagccattccatccttaaggagcaactcagttttcttattcttgacttagaattggttgcatcccgatgtctcctctgcctgcacttcccaggaagaaccccctgaggccctcagattttcctgcacacgcccttcccagaccctctgatgactgcaaatcccaccctacccttgacgggaaactctctgaggctgtccaggtcatcacccccagggaccaggtactggtgggggaatgttccatgaattaattgctgtactcagggctcttggacaagtctcccctgatcgcagggtcctgactctccctgtataagatggaggctctgctgctcaggagcctgcctggcttccagtggtctagagtggagctgcactgcaatggggctggacttaggctccaggtacccacagggtgggtgcagggggaccatcacagttcagcttcctggtgccatctgtggtgggacctgattgtggggcaaaggggtgggacataaaaggcagagtgtcgaggcaggtacagaacgggtggggggtgctccttagggagaaggcaaatctagaattccttgacctcataaggaaacagcttggatccgtatggggaggggtggcatgggggaggatggagcagcacttagtacacagaggcctctgggagaggggccaggattgcagaaggcttgcagaggtgctggggaatctgattttgtcaaaactaaaaaatccacaaggcagcctctgagcagcccagagtccaaactgccatctgtcccctcagctctgaaagatgaggtgcaaacccctgccctacccaaggctctcctgctgcacactgccaggcactgtcttcatggacccacacttccttccatattgctggggacacagtggggccttgccaacagtgattcctctttgttaggatctttgcgtgtagtcaaaacagggccccatctcctcattactcccccaggtgtctacctcttcccaccccatgggcaaacctccatggatgactggtctgtgaccctcaccagccaggccagccattctggacatgaccagagccctcccctcttcttcccttgtcaccagccctcaactgtgaaactacagatggcatgtcacctcttcatgctcccagtttggggcctacccagtgaggggcacactagttgattccatacaccctcagctggctttgtttagaatgtgaatgtcacagccaggcgcggtggcttatgcctgtaatcccagcactttgggaggccgagccggactgatcacttgaggtcaggagttcgagaccagcctggccaacatggtgaaatcctgtttctactaaaaatacaaatactaaatactaaaaatacaaagccaggcatggtggcatgtgactgtactcccagctactcgggaggctgagacaggagaatcacttgaacccgggaggtggaggctacagagagccaagattgcaccactgcactccagcctgggtgacagagcgagactgtctcaaaaaaaaaaaaaaaaaaaaaagaatatgaatgatgaatgtcacctcctttctcttctccatgagacagccaatatctgatcaaggccctgggaatgggaatccatagctcgccacccacgtctgccccctgcctagccacgctgcgctcagggaccattccgacaggagaggacgccccacttcagctccccccagtgccccgggtgaatgaacggcatgaagggttaggcgggcacacgtcgtctctgcacgcatcgcacggcgccctctgcccgcgcccactggcgtgcccgtcggcatgcccgggccccttcgaagactgcttgcttctggagtgccagcggcctcctggcccagtgccccatttcctcccgggtggagcgagggaggaggaagggaagcagaggggtaggcggtggtaagcagcaggcacatgtgcgcgggcgagagccccgcagactgggaaggcgggcccatggcagggggtctgcggggatcgcgtaggcgcgggccttgccctgcagccgcttcccgggcgatgcgcacacaaagcgccctcggcagcgcctggcccggggcccgcgctctcttagggtccgggcccttcccgccgctgctggggcggccgaccgggatgcggccggggaaccctaggctctggggccctgggaagggggacgacggcggggagtagggatgtgcagggatcgggcgaagcccaagcgacttagggaccagagccaccccaagcgccgacttcgcccgctcgcacgtcccgggtccctcgcgcgcaggccccgcccctctcaccccgccgcacgccacagggtgacgtctgggctcccagccgcatcgccctgactcccgcgcgggccccgccccctgccgctagccaatctgtgcgtttgtgacttttgggcccgcagccccgcctgctcccacagcgataccggtttgcattgccctgactcccgcgcgggccccgccccctacgccgctagccaatccatgcattagtggcgtccgggctcgcagtaccgctcgctcccaccgcgagaccttctgctccgcgcccgcgcgggcccctccccctccatcgctagccaatccccgttttgtgacgtatgggctcgcggccccgctcgctcccaccgcgagaccttttgctccgcgcccgcgcgggccccgccccctccatcactagccaatccccgtgcttgtgacatatgggcttgcggccccgcccgctcccatcgcgagaccggttcccaccgccctgactcccgggcgggccccgccctctccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacctaggggatcgcggctgtgtttggataaatccaggggggcactgggtacaaatggtggctcttgggcctccggggagactctgtgtgactagagcaccctggtctgggatctaggctcagactcttcctgagagtcctgggggcaaaaggggatgctggggcatgagcacaagtggcaaggccccatggataaagggctgaacacccagagccattcaggagggtgtgggttcctggcctctaaccaaaggtcagaggggactggctggggaagtttggactgagggacatgacagggccatggtggccctgccagccagtcccctcgccctgactctcttctgcaggtgcatgatgacgatcttttgtcttcttctgaagaggagtgcaaggataggtgcgtagtgggggagcccagggacgggctggttctgggtccaggctcctggcccacttgctcccctcttttgcctcagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaatgcgttggctcttcctggaggagagggttgggctcccatggcaagggcctctgcgtcttggggctccaggattgcaatccggctttgttgggtccgcatttttgctttagtctggggataggaatcaaatgttacccagagatgtttgtgttttgtttgggagttttattccctaactcattccccaaagcacgtgtaactgcttatacatataatcgtggtacaacaaggtatatacagagaacccacttggaaattcaggcaaagctgcatgcacgctaccagcagtctgcgggtgttttaactggaaaaagctgaagtccacctcggtgtccaatggcatggggatggaaagaaaatgaggcgtctctggcacatcattctcagctcctggaactgctgcttgtttaacatgggagaaaagctccaaaggctgaaatgccccatcatccctgggtgattgaattcacctgcctatattctcacttagctcccaggttttctgccctgggtatgtatttcataatcttcaaagtatatatatatataatttttttttttgagacggagtcatgctctgtcacccaggctggagtgcaatggcacaatcttggctcactgcaacctctgcctccgggttcaagcaattcttctgtctcagcctccctagtagctgggactacagtcgcgcaccaccatacctggctaatttttgtatttttagtagagacgaggtttcaccgtattggtcaggctggtctcaaactcctgacctcaggtgatccacccatcttggcctcccaaagtgctgggattacaagtatgagccaccgtgcccagccgaagtttactatatatattatatatttatttatttttttgagatgcagtctcactgtcgccaggctggagtgcagtggcgcaatctcagctcatcgcaacctctgcctcctgagtccaagcgattcccctccctcagcctcccgagtagctgggactacaggtgtgcaccaccgtgcacggctattgctttgtattttagtagagacagggtttcaccatgttggccaggatggtctccatctcctgacctcatgatccacccactttggcctcccaaagtgctgggattacatgtgtgagccaccgtgcccagtctacatatatgtttttaagtggaaagtgggtactaaaacccaagacaatgccacgtgttgctgtgcatgcctggctctatgctgctggcagagggcgggagagcacagaggggctgccgtccactgcacacgggcaggtgggaagcagaggcccagcaaggggtggggtgctggcattagtcacccaagcctttggctccttgctgcaggtagtgggacagcccagcctcccacacttggcacagctcccatgtagtgcctgcacatgcatttgtggaggcagggctggggctgggaccctccctggctactcctgaccatttatcttggctgcatcctcgtctctcctcacgtatatttttggtcctaaaatagtacatggtccttgtgtgttgcaaacatgcagaaaagagtgaatcacttctaattttcttaccactcacagtttcagcctttcttgtttcattgctatgagctcctcttacctggctcaccccgcagtgcccagccacttgctgtgtggattccccaagcccctgccctctgcccctcaccatcccaagcccaatgcaaagactgatggctggccctgcagcaggcgagacctggatggtccatggcgggtggtaggcatgggcaggggatgccacctcctcacaggtccaccttagggattcaatggtcccattaatgagcctgtacatggggggcagaacaaacaggttgctactgccaggaccctagaaggacgcagtgacagagcctcctgtttcagcagctgataaaaaccaagtacactgacaggaagaaccgaactcacctcagtccagttcccccaggaagcactcactacctgggattggggctggactgcagcccagtgtggctggacagaggcagatggggcctagcaggaacctacatgggacctggggtggtggcaaggttgacatcccaaagctctggagtaatagctggtgtcagggagatgggggatgtggagctgggcttggggcatcccaaggagggaaaagatatccagatatcgggacgaaatggtgctttctaggccttaggtcaggtcctggatctgttccaggtggggagtaaagaggaggtagctgggtgtacttggcaaccactgtggtgtctggcgtgagggaagagagggaaggaaggaacagcggccacccctgacgtagcttgccccttttcattcattccaaaagagctcccaagattggatggaagagggctcccggagtccccaccccagttccccagggaatgaaaagggctgcgagactccctgctcctgagggctcatggcgttccccagggctctgctcccaccacctccctgagctccctctggattcctgaggcctcccacttgggcttggtcaccaatccccagggctccatgggccttggagtactccccccaccgtttcagggctcctcagggttctgccaaccccatcctgtgatctgtccaacccccagggcttcgaaccccatgaaggatcctgactattctggacacaccgaagtgcactgggtgccccagccggaaccagaggattaggaaggttccatgggcctcaagagcctccaggcctccacttacatgttctccagagctctgagagaccactgtggccccactttccaaagttcccaaagaatctggggccccccgcagggctccagccatgctcagacatacagcagggggcagcagctgcccaaggtccaagcgagaggccactctgggcactgtccaagaagatactggatttttttcctccgctaccaccaggccctgccagaccagggaggagaaccacctgagggggctgggagagtgtcgaggcagccagtggagaaggagactgtggagagggactgcagggccagggtccagaacccatggtcctggcaaggcccttgaccttggccccagacaggtccaaaagaggtgacagcgccaagaccggccaagaaggacatttgccttgaccctcagctgggttggaggtacgaagggtgtctgcggggctgctaccactttcaagaagagagtgccaggggtgtaggacctgtggcttcatgagcatggcacactcctgactctgatggcataaaggaaaggaaaacggcagaggaaccctgcctgacttccacctggggctgggctgctggccccaggctcagggcggccactcactgggagacacggggcaagcaagacacagaaaggggaagtcccacccccagccgcagccactctactgctccccctgggcccaatggcatagaggtaaaggggccaagcacactctggaagcctctaaaagccaccagctgaacggggctgtgaggcagcagagccaggcccagaaagatgcagtgccagttgggaggacgggaggtccccctgaggctgcgacttgtccgctcagcccactgtgtgcccaggattctgaacctctggggcactccctcctgtcccgagtcacccagggtctcctgccccctccctgtgtctgctccatcacatcccctctcaagccccatgcctggcagggccaccgccctagggctgggctaggtgaaccaagggcaccggtcccccaaacctgccgatcgtccccaggctgcagggagggacacatgtggggcggcaagggcagaagataaactagggggatccgggcccctgaggacagccctggcgggaggccacaggcctcacagggtggtgagctggaggccacccaggcaggcaggcaggcagcagggaaagagactggcacggtcctggccagggccccccccgggaagggcgggcaagtaggagcaaaaacaagagcagagcacgggcccccaccctgccgggtcctatggcctggggactcacacacactgaggaagacccaggaggacccgccaggctactaggaggagataaagggtgcacaggcctccaacccgcaggttgtgtctggactgagtccagggagggcagggaggggcggtagcccagttgaccttccctcccccaagccacacctctgcaccccaaccctcccttccgcctcccaacagccccatccccgctctccgaggaaactgggaggggacctggagaggaaagggaagcaacggcccctcagagcggggttccccaaaatccatggccagggactgaggccagcactcagacactgttgggaacactggccaggagtccctcggggtggacctgggaacctgctgcagaagcttaggggaccgggccagctcaggaaagggctcaggctggaaaccgagcagacagggcaccgctggacctggggccgaggaggacaggaagtaggtgactatggaaagacccccgccgccacccacgcccaactcggcacacaaaggcccagagaggcccccagacatgcctgtgggggcaggggtgtttgcaaacatttgcagagggaccgggtgtcccaggcacatggacagcttgcagggcccggctgaggctaggacagcagcaggtggctggcaggaggtgccccgccagggtccccaactgtgtggggggcaggcccgaggcaggcggcaccagtcccgggcaggatctctcggaagaggggccgtacccagccagggttcccagagacacgggtggtggggccgagtgccccctcaccctgtgcctggcccccaacaaagggtgagcatgtatccttcctggacacggtgtccagggcagggcactcccgaaccaggatgccccctaggccacaggacccctcagccccagctgacagcagccgggggggatctggggaggcccccaggaggcagggcggcagccaagcagaacaccatccctggacccactctccaactgcaaccagggcccgctcccccgaaggcaccagctctccctaggggcaggaccttgatccagagcaggagtggaggcccccaacaggggacggctggagaggccctgggctcacgagccagggagcggcgcctctgtgcccggaagcccctgggtcctgcctgggctgctggtagctgctgcgggccgaggggtccggacgcccctagggtgctctggggcagctcctttgggaccctcaatggagccagtaagtccaggagggcgccgatccgtccaggtgggtgcatgggccgggacagggtctggctgctgtcgtggctgtgcccatctgccgaacaggtcgctaggagagcactccctgagcgagggcgccgggcagcccggggagggaggacacagtccccgtccaggcccccgaggcccccatagcagggagagccggccctcctcgctgttcttcccgcgggatcgggccggcacctcggctcaggggagagagggtcacagaggacagccagcaggcaggtggcccaggagtgtggggggtcggtgggcctgaccgtgtcctgaagcaccccaggaccctgtacccgacaccctgggggaggggctgtccccacttgccaggaacacattcctcagggaaggcccggcaacctgctctcgtcgggttcaagaagggccaggcggctttggaaggggccaggagctgtcaccaagggcccccgcattgcccagaggcggcgcgggccaacaggaaaagcactcaccgcccacggaacctctgtgacaaactcagagccacggagagcgtcatcagcaagtcacttgccagtcccagtgggaaggatggggcacgtctccagggaaacgagacaccaaggtcttcctggggccccagtggaaagctccttccaggacccacctggccctccacatcccaccctccaggccagggacgggagcccagtatccggcaacctgacacatcacggagaaaaggagctgctctgccttcaccatgacgacgcggcacaccccctccctgccccggcccctccccttcagggctgcatgcggggaggagaggcctcccctgtctgcagagagaggctgccccacctggggcagagaggggacaggggcaggaatgagcccctgggaggggggcattggaggtggggggcacatcctgccacccgggctggcgtggggcactcatgccatgcagaccagaacgggcttcccaccggctcctggggatgttggaccggggctccccgaccagggctgggaaaggcttccatgaagagccagagagcacacggcgcagaccctgcggggcacacggggtctcggtggcagagtctcccttcttggggttctctgtgatgggttttgcaaccctttcaggatgtcaaagcacgccccgccctcagaaatgcaggccccggccagtgtcagccccaggaggtggcctgctgctcccgctgacaccaaggacatgttcctgaggcggcccgctcgggatctccagcagccgacgcaggtctacacgtgcaagggtgcttctgactcgcagcactcaggaacagcctccaccctgagcgtggcgccctctccagcacgcgccagggtggacctgtgagaccaataaaaaccacagcggaggcgaggcgagtcacttaggagaccaggccatgaagagactgtggccgggtctggggcgccctctcctgctggttcgactggattgcaggtccgggggaagcccagcagccctggggaggaggcccggtggggaggaactgaggcctcctgccacagcctccagagggagagtcatcacgagggctccccacccagtcagataggatggctgggccccagtggacacctgaccgcagcctgagagggaccctgagccacagtcctggctccccgagagccctcccagagcctgtccctcagaacccttgggggggtgacacgagtgctgggggggtgagacgagtgctaggtggggaaggaccgaaacgtgaagtcgtctgttacccagtagtcggaactggtgcccagcgtccagggggcaagacacggcgtgagccagaaggaaacaaaccgacaagaacccccagaagccatcaggaaagcctggagattctgatgacacgaaaactaaaatcccctctgtgaccaagcacaacccgcaaaccacacagtcaagagacaagtgataataaggggagaaaatagtagcaagaggtgactaagggctcgcgtcagtcacacacacacagagccggacacacggacaaggcaaagtgcaaggacaagagagcaaaagggggcggaggagaggaagggagagggaaggaagcgtcttctccaccgggatgcaattccttgggagcccgtctgaccccagggcaaagagatgctgggtcgccagagccgccgcggagaagtcccgccgggcctcagagcccagcaaagaggaaccagggcggacgggccaaacccagcggccggctcccgggggggtgggtggtggcgctgcggggagtcgcctgagcagcatcaccagcagctgggaaccctcccggtgcgggaaggttggcgggtaaggcggggcttccccggaaacactgggctggacccagcggtcccatgggtgctggaaccagccctgcgggtgttcccaggcaccctcccgcgggaagaccggctggagggatggctcctgttggcacccacgtcgagggaagccaccgccttctctgcggggctcgcctttcctacctcccccaggagacagtcaggccaggaagcgccccagcccacgaccgcccgcagcagagcaggattccctccccggcggccgccgctgtcaagggacggggaagactttgttaccccaccgcgcgccaccgcggaatggtgcacagacacctccagacgccacttcccccaagacggccgcccgccccgctctgcccacctctccctggacgctgccgggtgggcgcggccctgcttccccacgaccccccagacgcgccccgaggcactttcgcagcacagtggagtgggaagggcggggcggcccctcgacggcgccgaggcgagagcggctcacggggcttcccgggccctgatctcaggcgacgcctgtccgcctcgtccccgggggaagacagtgaccaccggtctgcaaaggaaggggactcggcgcatgccccgcagggccggcccaggactcgcaggcgcggaaggcggtgccgaggcgggggcggggcgtggagggacagccctagtctccgcccgccggggcccacagctgcctcgctccccgcctccgcttcggtcgctcccggtaagctccaggcgcccacgggaagccccgcccagccccgcctatccgtcctcctcttcgcctgtcctcgccaatgaccatgctcagattgcacggaattcccgcccctcgcccttgactgacgctcctgctgcccagtggacgacaccccgtcgcgtgcgcgccgctgcggccctgccgggtgtggcgcggcgctctcaggctcctaggcgttcccggggcgagacccagggcgctggccgcagagtcgccggtgcacacgcaacagtgccgccttgtgttttgggtgtggacctgcgcttctctaagcgttccattcccgagaaggggcgagaaacgtccagaggtcgtggcacctgcccgccgctgccggggcgtcggccgtgggcgcaagtgaagcgccccgggagcgcggcgcgacgtccgtgccttccgagggcggcccgggtgtcgccgcggtgcgcgcgggagggcgcggccgtgggcatttccgcgcttgcgcgggttcctgtcccgccccggccccggccccggccccggccccggccccggccccggccccggccccggcccctccctctcgtggccccgcagtagacgcagcccctccctcccgcggtgcagcgcagccagggctctgctccgggagtcatggagtccatcaccgcggagcgttatctcagcggacccacgcggtgtcctccgctggggtgggccgagtaccctccgcctcccgcccgcgagatccatcccagcccctggcgggggcccgtggttcttcccgctcatggccacggaacggtccacgctcgcggagccgcaggctgagcttttgctggtgagggacaaggtcgtggtttcccgtggctggtggccctcacggaggagcctgctgggagcacgcccgtgtagggtttcctgtcatcgggttgccacgcccatcttgaacgctcgagtccacgcagaagtgtagaagtggatgtgtagctttatttgtaattctctttctttcttcctttctttccttctttctttccttttctttctttttgagtcagggtctcactctgcgcccagtctggagtgcagtggcgcgatgagggctcactacagccttgacctctccaccccagcgagggcttcaacctccagcctcagccttccgtgtagctgggactacaggcgcacgccaccaccatgtccggctaattttttactttttgtagagatggggtctcgctttttcgcccaggttggtctgggattcctgggctcaggtgatccaccccagcctcacaaagtgctgggattctgggcaccgcgcaccggccgccgcgcccggcttgatgtgtagtttcaatagaaaccaccaaggtcttcagggtggcctgtgcatcactttacacatactcaagcgaatcattgagaggtgtttgaggccgggcgcggtggctcacgcctgtgatcccagcacttcgggaggccgaggcgggtggatcgtttgaggtcaggagtttgagaccagcctgaccaacatagtgaaactctgtctctaataaaaatataaaattagccgggcgtggtggcgccctcgcctataatcccaactactcaggaggctgaggcaggagaatcgcttgaacccaggaggcagaggttgcactgagccgagatcgcaccacggcactccagcctgggtgacagagcaagattctgtctcaaaaaaaaaaaaaaaaaaacgtttttgaaacaacttgaagcaagttatcccatgtataaaaaagcatgaagttatttatactatttttctgtgcaatcacccacataattagccaagttaagacccattatgcggccgggcgcggtggctcacgcctgtaatcccagcactttgggaggctgaggcgcgtggatcacgaggtcaggagttcgagaccagcctggctaatatggtgaaacctcgtttctactaaaaatacaaaaattagctgggcgtggtggcgtgtgcctgtagtcccagctactcgggaggctgaggcagaagaatcgcttgaacccgggaggtgaaggttgcagcaagccgagatcgcaccactgcactccagcctgggtgacacagtgagactccgtctgaaaaacaaaaacaaaaaaaaaccgttatgctacacgttttgtagtgattttgttttgtttgttttagcttttttataatttcaacttttttgtttttgagatagagtctcactcttgtcgcccaggctgagtgcaatggcaccatctcggctcattgcaacctttgcctcccaggctgaagggatcctctcacctctcacctgggttggtcaggctggtctcaaattcctgacctcagtgatgcaccagcctcggcctcccaaagtgctgggattacaggcatgagccaccgcgcccggcctgatgtactttaaacttttttttttctttttttgagacagagagtttcactcatgttgcccaggctggagtgcaatggcgtgatctcagctcaccacaacctccacctcctgggctcaagtgattctcctgcctcagcctcccgagtacctgggattacaggcatgtgccactgcaccgggcctccatttgatgtacttttaaagcattattatttctaccttgcatttactatgaacacagccttgaacgtgcatccatctctctctagaataattacctgtaagtggaattgctgggtcgagatatatgtacattaaaaaaaaaatttttttttttttttgagacaggatctcagtctgtcgctcaggctggagtggagtggctcgatcacagctcaccaccgcctcaacctcctgggctcaagtgatcttcctgtttcagcctcctgagctgctgggaccacaagtgtgtgccaccatccctggcttttttagaaaacttctttttgtacagacagggtctcactgtgttgcccaggctggtcttgaacccctgggctcaagtcctccctccttggcctctcaaagtgctggttttacagatgtgtcccaccttgtgtggcctgcatttaaaattgtaagagacactagggaattgcctcccctaaagaccctacctttgatactgtccgtccctcgcattgtaccctcagcgtttacccacagcctcaccagcaccttttgggctaacagctttttaggtagctgaaaattagatgggagaactgtagcttttcgctttttccttcttccctgtttcctagtcctgttcccctccctcccaaaggggtcatttaaaatgtggtgtcatttggaatgtgtttgttcaattgtattttagttttctgagacagggcctcgctttgtcacccaggctggagtgcagtggtgtgatcatagctcacggcagccttgatgtcccagactcaagtgatcctcccacctcagcttctggagtaactaggactacaggcatgtgccaccacgccagctaattttatttttttgtagagacgaggtctcaccctgttgcccaggttggtctcctatttctggcttcaagcgatctgcccgtctcggcctcccaaagtgcttggatgacaggcgtgagccactgccctgcacctgtggattttttgtgtgtatggttttgcccaccgtaactgtccctgtgctgcattcctattctgctgactgcttccgtcattcaacagggtttctcagctctttgtctgtggccctggagacgtacagttgactcctgtgctcctgcagaggatttcagagcttggatgcaacacatttgatcattcccaccctgagtgatgcaaccccagggcttcagctcctggtgtgccacaaaccatgccacgaaggccatggcacggaatgtggccttagcgagaagggagaattgctcttgctgaggttatcaaggggtaggattgctgggttcaagaacactgatgtttcattttcttatgtttgttctgttctttttttttttttttttttgaaagagtctcactctgtcacccaggctggagtgtagtggcgcgatctcggctcactgcaacattcacctcctgggtttaagcaattctcccatctcagcctaccgagtagctgggactaaaggcgcacgccagcatgcctggctagtttttgcatttttagtagagacggggtttcaccgtgttggccaggctggtcttgaactccggacctcaagtgatccccccgcctcggcctcccacagtgctgggatgacaggcgtgagccaccgcgcctggctcctttcccattttctaagggacagtcagtctcctccataccatttgtcacacagcctttcccccatgatggcactgccatactcccgctaaatgcgcaggcatctgtggtctcctctgcacttgtccttccagggaacgatgcagtgggctccttgctttgcatctcgccatacctggtgcacctgccagctcccttagcaggaccttgcagacagtttcagtcattcttgggcattttcttctccatgtgaagtttcccatcatcttgtcccggaccattagacacccacatccctggcttcctgggactctggtggcgtgatgggaagagcccacttcttaatattgtttttttcaagaggatctcattcttagtccaggtggcaggaatggtttcccctgctggcctcagctctgttggcaagggatacctgcagtctggggcctggagttggagcgctccagacacggtcccttccttccgggagtttctttctcgtgggtgagccagaagcaaacacctcatcccacagttctgagggcctgggtggggccatcgtcctggtccaggtaagagaccatggagtctggccaagcacgttggctcctgcctgtaatccccgcactttgggttagggttagggcaggaggatcacttggctccagcagttcaagaccagtctgggcaacctaataaggccccatctctacaaaagaaaaaaaaaattatccaggcatggtggcgtgtgcctgtagtcccagccgattgggaggctgaggcaggagcatctctggagcccaggagttcgaggctgcagtgagtgttgatcatgccactgcattccagtctgggcaacggagcaagaccctgtctcaattaaaaaaaaaaaaaagccgggcgtggtggctcacacctgtaattccagcacattgggaggctgaggcgggcagatcacctgaggtcaggagtttgagaccagcctgaccacacggagaaaccctgtctctactaaaaatacaaaataagccaggcatggtggcacatgcctgtgatcccagctactcgggaggctgaggcaggagaattgcttgaacccgggaggcagaggttgcactgagctgagatcgtgccatggcactccagcctgggcaacaagagcgaaactccatctcagaaaaaaaaaaaaaaaaaaaaaaagacagtggagtcctagatggcgagggtagcaatggagaaacccacttcaatttctttgagccaacagttggaaggattcccgtgggaaggtcaggagggagaggagccaacaggtggaactccgacagttcccccgtcctcaccttgtagggctgcaagattccttggtgcctgtctgggctccagggcccccacccacccctgcaggcttatgtgcggatcagcaagaggcactctgctctcggggcaggtactcggctggaggcgaggacacgggagggatttcagccctctcgctccccaggaagatgtccttgtgcagagaacagcctgcacgacctactagggcacccaggattaggctgtatcctccgtctgcccaaactggctacagaaagctcattttaacgcccactagagagtgaggagactgtaggtgcaatttcttttttcttttttttctgagacagatgagtcttgctctgtggtcccaggctggagtgcagtggtgtgatcttggctcactcaaacctccacctcccaggttcaagccagattctcctgcctcagcctcccgagtagctgagattacaggcatgcgccaccatgcccagctaatttttttatatttttagtagagacgtggtttcaccctgttggccaggctggtctccaactcctgacctcaattgatccacccacctcagcctcccaaagtgctgggattataggcgtgagccactgcacccgccctgtaggcagatttttttttttttttctgagatagtttctctctgtagactaggctggagtgcagtggcatgatctcggctcactgcaacctctgtcttccgggctcaagcaattctcctgcctcagcctcccaagtagctagtattacaggtgtgtgccaccacacccggctcatttttgtatttttagtagacagggtttcaccatgttggccaggttggccttgaactcctgacctcaggtaatccgcccgcctcggcctcccaaagcgctcggattacaggcgtgagccacagcgcccggccatacacgaatttttttgagacagtcttgctctgtcgcccaggctggagtacagtggtgtgatctcagctcactgcaatctctgcgtcctgagctcaagcgatcctcccacctcagctgggattagagtgtgccgccacgcctggctaatttttaaatatatatatatatatatatttttttttttttttttttttttctgagacggagtctcgctctgtcacccaggctggagtgcaatggcgtggtctcggctcactgcaacctccgcctcccgggttcaagcgattctcctgcctcagcctccgaagcagctgggattacaggcaccagccagcatgcccagctaatttttgtatttttagtagagacggggtttcaccatgttggccaggctggtctcgatctgctgacctcatgatccgcccgcctcggcctcccaaagtgctggaattacaggcgtgagccactgcgcccagccaatttttagtttttaatttttgtagaggcggtttttcgccatgttgtccaggtctcaaattcctgggctcaagtgatccgcccacctccgcccctcaaagtgctgagatcacaggcgtgagccacggcactccgccgcaattcctgacttgtactgccccagtggtgttacagcctcgaacccagtttccagacctaagtcaccgccggcatccagagtcccatgatggaaagggaggctaggttcccctgggaaggaccttgcaccactgctgcaagtgcaccccagaaatcgtcccaagcttttctcaaagggacctgcagccatttataaaagcgacatatcatcctggaaaacaggtgcgctcgagcaggatttcctcccgtccttcctgtcaaaggacgggaagactttgttaccccaccgcgccccacctgcagaatggtggacagatacctccagatgccacttcccccaggacgcccgcctgctctgcgcacctctccccggatgctgccccgtgggcgggtgggggcggccctgcttccccacgacccccagacgcacccggagggactcttgagcacagtggagtgggaagggcgaggtggggcggtgcccaggcgagagcggctcatgggaggcggcgcccgagacgcagctggtcgggacggtgcgggtcagggtgggcggagcggggctagagatgccccggggtttcccaggccatgagtctccgtggagatttctcctcgacctcttccccgcggcaatgtgcgaaccctgggtctccaggaaacggggatacggggcatggctcccagcaaggcctggtccagcctctccggtaggggaatgggtctccccctccggcctcccgggttgacaaaggaacgcgggcccagatccccgtatggcgcttcaccgccggggcctctagcctagaaggaggcacggagcgcgtgtccgagacccgtgcaagctcagggacactctcgcggtcgccgggaggcccacctagggtactttccttttttccactctcagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttggtgagtcttgaatccgtgtactttcactgctgggaaacgggcggggaaagaagtgcctatggccgctgaaaacaattgtggggtggagcctcccccgtgcggcggccctgtcttgggaactgaccctatgttttacacctcccggctattttttagtctgcaatattactgtctgttccttcgttcccgtgtcggtgtggaagcgacggttccctcgtatctctgcctgtgtcctgcaagctcaccgcattttcgggcgctagatacgctcttggggcctttgtgtgcgttctctgtcttatttccgggcgacgtgccgcgtgcgttgtcggacgtgaagggcagtccgggaaaaacgggtgcggccgcctcctgtgtcctacagggggcgccagacgcatttccactcggcttggaggtggatttagtgccacgtgcccgaaagtcttaaattgggtgacctgagctgtgcaatgataatgcggcgattttgtagtacgcagtgtcttgaagagagaatttttaactaggaaagtttgttgcaaagtgtttataggaagcgtaagacaaagtaacggaagatggtgtctgttgtttctagtcttgggtgttgtctgtgttgcagcagccaactgttgctttgtagtttatttccccgaatggaaacggtttagaagtggacgtgcattccccacccttttcccgtccctcgtttgggttgttccttgaggggcaaagtgcctgttgggctttctgtgaacctcacctaacctgtgttttttcactcccctgcagttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaaggtaaggcaggattctttgttcgtcaccccccagtccttcctccgtgctccctcaaccccacccacatacactgcactggaattgggagttgatgaaacatgagccttacaaaactcagccaacacagttcccctgagctggagatagtcgtggtgaatgtttctctattatcttctctcactttgctgcttttcttctccctacctagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctgttctttggagaggaggatggaagggaggggtccggcacgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgctgcacaagtgtcctatctcaccaatctgggtttttgttctcagtaactttccttcttgtcatacaacatcttcattcctctttctgaaccctcccttcccctaccccaacccagagcccactttgtctccactcctgatactacactacctggcaggtggcatgagtgcagggcccctggcttcctctcctaatctaggcacaagcccaaccaaagaacaagagccaaatcaaacaaggcaggcaggggtggactacagtcacagggcaactatagttgaagccccccagccccagggctggatggacgggggaggctggggtttaagtcccaaaaggcagcaggccctgggggggtagggggacgctcaggcagcagggcacagctgaggggacaggagtgatagcagcaacagaacagtgaggctgagaggctggacgctgtgcgcctggctcagcttcagctccacctccacggggtagtggtcactgatgttgagggcctgggaatgggtggtggggcagtgtcagtgcccggggccgaggggcttccctgtgaccctgctgctgccctccctcctcatgccagccccatcccttcacctcctcctcggtgagctggaagctcgtggggaagtcaaaggcagccgcagtgtgcagcagactccggcagcgctccccgtgcagcacgacgcggtcataggtgcagtgggtgctggcccgcactgtggtgtcctccccatcggcaatcacccagtggaagcctggctcagtccgcagctccagcttgtccaggcgctttttggtcagtgaagcgcagtcagcattgaagtccccaagcaggatcacgtcctagagacacagcagccatcaggctggccgctgggccaccctatccttgtccctcctgtacaaactgcccaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacataccaagcccacccttcccttcctaccattgctgggcaaagagaactgggccacaaatggctcccgggcaaagacgtcatcctcatcgttgtacacgtaggaactcaggacctgtgttttgtgtgacctgggaggacaaagggatgggcagcagtggccccacgtctttgattttggcttgcaagtgccaaacggcgctcagggaggggccctccactaacagcggcaatgtgggcacagccctcccaacctgtctctagaactttcaaaaatcaggcataattcatatgccataaaattcacctgcttcaagtatacaacacggttcttttgtacattcataaggctgtgcaactattgctacaatcaattttaaaacattggtatccattactcctaataaaaacataacatccattaccagttactctccattctcccctccccccagcccctgcaaccattaatctgttctctatcttgtacatttgcctattctggatatttcatatgaatgaaatcagctcatcaatgttttctgcgttcgtccatatgctgtggcacgtctgtgcttcattcctctttctggctgaataatattccacggactgggtatagtacattttgacatttggacactttgatgtcattctttttttttttttttttttttttgagacatggtctcactctgttgctcaggctgcagtgcactggcacaatcatagctcactgcagccttgaactcttgggttcaagtgatcctgctgcttcagcctcccaaagcgttgggattacaggcatgagccactgtaccctgcctacccagtaattttggagcgcataccagatgtcatatcattttatttatatagagaatcagttctccttccctgcagcctcccttgccctctggatcctgactccaaagggctccctgccagcctgtcctcccagggacttagaagatcgggtctacccaaggcccataagtggtccccacggagcctcttcccaggagctgcagcccttgctggccactttcatagagggggccagccacaccctgagccccagcagctcccacaggagagaggaggagggaccccacatttgtgcttatagaaggaaggcctcctgctctatggacactctggcgggggtcgaggatgggaagagcccagaataaaaggtgttgagaagagaaagcatgcaaagcaggtgaggctgtcccaggatggggggcctgtggccccggggactaatgagcctacctcacattagggccaaggaccgccccccaccctgctgcgctgccagctccgtgctcaccgatagaagtacacatacgtctccatgtaggtgctgcgccccagctgggggctgctcagggtgctgtagggcccagagccatcaaatctgccaagaaaaggggaggcggggtcagggcctcaagcctctgggtgtgcccctgattagacccacagaatcttcctcaccgattgagttctcgaagcaggagggggatggcgctgccggaagagtccaccacctcctgcagcaccatgatgtcacagcgagccagtatctgtgggacatcaggaaggccagcctgactcagtgccaactgccctgagaggaggcagtgggcccaggggactggcactgttgtggcccagagtgttaaggctcactggctgcagcccacagaaagcagtgggactggaaatgccccaggaaaagactcatcccacccacatgtcacctgtttcacagaggaggagactgaggccagcagcaggcaagcgcctgcgctgcatctccgtgccacacctcttcttctcccctcttctctagaacatacccctggtcaggcagggatgggggctttggctcatggtggttaggggcacggcttccctgaagtgatgaacttacccgaactaaggtgtccatcacctgctccctggccaccttggccagtgtcagccgctgggcattgaaggcgcagatgcgaaaggcctgggccccattggccaggatgaggaagaggagtgcagttgggtagtgcatggctgtgtgtggctgccggggacaccccaggaatccaggctgctccagggtgcgctctcactgggctcagttctggctctggaagcgctgaaatatggaacagagaaagtggcactagctgctgcccagcaccagcctcccagtgacctcccgagatcataccactgcactccagcctgggtgacagagtgagactctgtctccaaaaaaaaaaattgtttttgagacagagtcttgctctgtgaagatcaagccaagatcgcaccactgcactccagcctgggcgacaataagactccgtctcaaaaaaaagtgaaatcctacagtatttgtctttttgtgactggctcatttcactgagcaaaatgtcctcaagggtcattcatgttggagcatatgtcagaattttttttttttttttgagacggagtctcactctgtcgcccaggctggagtgcagtggcgcaaacgcggctcactgcaagctccgcctcctgggttcacgccattctcctgcctcagcctcccgagtagctgggactacaggcgcctgccacacgcccggctaattttttgtatttttagtagagatggggtttcaccatgttagccagaatggtcttgatctcctgacctcgtgatctgcccgcctcggcctcccaaaatgctgggattacaggcgtgagccaccgcacccggctgtagaatttctttccttttcatggctgaatcatattccattgtctgggcatctgggtagaccacattttgttcattcattcattcatccatccatctggtttttttttttttttttttgagacggagtttcgctcttgctgcccgggctggagtgcaatggtgcgatctcggcttactgcaacctctgcctcccaggttcaagcgattctcctgcctcagcctcccaaatagctgggactacaggcacgctccaccacgcccagctaattttgtatttttagtagagacggggtttcttcatgttggtcaggctggtctcgaactcctgacctcaggtgaactgcccaccttggcctcccaaagtgctgggattacaggtgtgagccaccgtgtcctttttttttttttttttttttttaaatagagacaaggtctcactatgttgcccaggctggtcttgaactcctgggctcaagcaattctcctgcctcagcctgctaaagtgctgggattgcaggaatgagccctggtgccccagcctcatgcatctcttgacctcgtgatctgcccgcctcggcctctcaaagtgctgggattacaggcgtgagccagagcgcccagcccctgctttcagttcttttgggtatatacccagaagtggaattgctggatcatatggtagttctagttttaattttctgaggaagtgtcatattggtctccatggtgactgcaccattttacgttctcgccaacagtgcacaagcggtcaagcttattcttttattgtttatttatttgggacaaagtcttgctctgtcgcccagactggagtgcaatggtgccatcacagctcactgcagcctcctgaattctatgtttcccaggctggtctcaaactgctggactcaagtgatcttcctacctcagcctcccaaagtgctgggatttttttttttttttttttttttttttttttttgagacagagtctcactctgtcgcccagactggagagcagtggcgtgatctcggcttactgcaacctcagcctcctgggttcaagcaactccctgcctcagcctcccgagtagctgggattacaggcacccaccaccacgcccagctaatttttatattttttagtagagacagggtttcaccatcttggccaggatggtctcgaactcctgacttcaggtgatcagccggccttggcctcccaaagtgctgggattacaggtgtgagccactgcgcccagccagtgctgggatattataggcctgacccactgcgcctggcctagtctacctttttttttttttttttttttttttttgagatggagtcttgctctgtcaccaggctggagtgcagtggcgtgatcttggctcactgcaacctctgccttccgggttcaagtgattctcctgcctcagcctcctgagtagttggggctacaggcgtgagccaccgcgcccagcccccccccttttttttttttttttttttgatagtctcattctgttgctcaggctggagggcagtaatgtgatctcagctcactgcaacctccaccttccaggctcaagtgatgctctcacctcagccttccgagtagatgggactacaggtgcatgctgccacaccaagctaattttttttttctttttttgagatggagtctcactctgtctcccaggctggagtgcagtggcttgatctcagttcactgcaacctctgtctcccaggctcaagagattatcctgcctcagcctcccaagtagctaggattacaggcacgtgccaccacacccggctaatttttgtacttttagtagagacagggtttcaccatgttggccaggctggtctcaaactcctgacctcaagtaatcctcccacctcagcctcccaaagtgctggaattacaggtgtgagccaccgcgcccggctaccaagctaatttttaaaatttgtttggagagatggggtttcaccatgttgttccaagaccccagtgcttttcgcctccattagcaactacaggaacatcttcgttcatctctgtctccccacttgtgagatgttctctttaagataaactcccggcagtgaagggtgtgtgcattttaaaaggtctcagatatggccaaatcatccccattgcaacctgtgatggggactctttcccatgcccctgccaccactggggagcccttcttgttcatctcaccagctggaggccccctctctcagtttatctttgtctcacactcacctgaccttgcagggctcggctccttgctccacgccctgtccatgtggcttttgcatcctgaggcatgagttcctctgctctgtctgcctgcttttctctatcaacctgtcaccttcccttcgggctcacttcctacctctctgaggctctgtccgtctctgtctcactttccctctcgtctctggtttcccttctctgtctctctgttgcggtgtctctctcctggctgggtttgatgtctgtttctccctgaccacctgctctgtcactcatgctagtttgggttccctaccctggtgcctattctgggatatacatgggtatgtgggcagccctgggctggcacatgcagccttggaggctctggcgtcagggacccccatgagggctaccagtaagaaccagagagagtgacggttcctggcttcagccccaaaccctggctgtcaatatcagccttggtgggagccctaggcttccctctccctctcaaaccctccccaggcagaaggcaacttcctcccttcttccgtctccccagggggctcccatacctgctcagaccagcttgtcaccaagtctgcctcatccttaagtggatcgcgataccccagaagagcagctcctgcctgaatagggctaggaggggaaaaaaaagaggaagaggctgtgttcctgagccacccggccaggaagggcctggctgggccggacgccccacccttgccaacaggcaggcccgccccgtctccgcctcgccgccaacaaggaggaccagcaccaggcctgggaactgctgacctgcccgcccaccttcccacccagaccccgccttcccgggccagcgggacatgacagacctgtgagtcactcaagcctggggcaaggaggggctggtgcctgagtgagaccccgagcttcgctcgccaggcccgtcgctcagctcccggtctgggtccccagtcagcagttgctggggaaggcgcaggagctggaagtcatgcctgatgccacgagaccgggcaccccaagggcgtgagtcttctgtccctgttgttgggttctgagtcccagtgtggctgcacacttctgagttaggggtgtttgatgcaagcgctctggagacccaaagagagggacagtccacacatgatctggccacagtcgtgaagtcaagggaggactgaggatctgccccagagaggaggagacccagggagctggcagtccaacgtcctgggggtcctgcagtaatgctgttgggacaaatgaggtgctcggacagggtctgtgagcaggaggtggggctgaatccactcagcttctcatgggatggctgtagctaatggattcgacgtggtaatagaaggctggacaaattttaaaaaatcaataaattatgggctgggcgtggtggctcatgcctgtaatcccagcactttgggaggctgaggcgggtggatacgaggtcaggcgttcaagaccagcctggccaacataatgaaacccgtttctactaaaaatacaaaaaattagcccggcgtggtggtgggcgcctgtaatcccagctactcaggaggctgaggcaggagaattgcttgagcctggaaggcggagcttgcagtgagccgagatcacaccactgcactcgcactccagcccgggcgacagtgcgagactccatctcaaaaaaaaaaatcaataaattatggtttaaaaataaaaaacaggccaggtaggatgactcacactttgggaggagaggcaggcagatcacctgaggccgggagttcgagaccagcttgaccaacatgaagaaacccagcctctactaaaaatacaaaaattagccaggtgtggtggcttgcgcctgtaatcccagctactcaggaggctgagacagaagaatcgcttgaacctgggaggcagaggttgcaatgagctgagatctcgtcactgcactccagcctgggcaacagagcaagactctgtctcaaaaataaaaataaataaaaataaaaataaaaaactgccgggtgcggcggcccatgcctgtaatcctagcactttgggaggctgaggtgggtggactgcctgagctcaggagttcgagaccaacctgggcaacatggtgaaaccccatctctactaaaatacaaaaaaaaaaaaaaattagccgggcgtggcgacctgcgcctgtagtcccagctactcaggaggctgaggcaggagaatagcttgaacccgggaggcggaggttgcagtgagccgagattgtgccactgcactccagtctggcgacagagcgagactcctaaaaaaataataataaataaataaatataaaataaaaataaaaaactggctgcttaatgcatagggggctttctttccgggtcatgaatatgtttcagaactagaggtagtagctgacattgtgactgtatcagatggtataaaatactgtttcttgtattacatatgatacacaatatgtttgtatatattgctgtatatattgtatattttgccatacagtagattatacattgctacatacacatagtatcatgtagtactgtaactatgtcaaattgtatatgtggctgggcggggtggctcacggctgtcatcccaacactttgggaggccgaggcgggtggatcagagtgtgatggcgggcgcctgtggtcccagctactcgggaggctgaggcaggagaatcgcttgagtctgggagatcgaggctgcagtgagccatgatcccatcactgcactccagcctgggtctggctggaccctgtgtcaaacaaaaaacagaaacactagagagacaaaaggcgagcgcaggaggctgccaggaagcgggagccccacggggtgacggccacttcccgccgccccggggctggcctcgctgccgtcaagcggcccgtgcgcgctttgcgacagtcggtcgggctgggcaccggcgcaggttcgctttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaatgtctctggcctctctgtaggggtgaaaatgggaagtgactgctggacagaaaggctgaacccttagtgccctggggacatggagcacacttgagcagatgggcatcaacctcttctgcaccagtcacttaaggcttcagttattgtctgtaatccctgtaacaacattgcagaaatagggattaatctcattttgccaaggaggtggagtgaggctaatgaacttgcttcaaaacccaaagctagccaggtagattggggccacacttcagagagacccaagtgtggagaatcaattggatcctacctgggctgcatcataggtgggagaggagctctgaagagcccggcaagcagccagccatgagcagtgcacgctgtgatcaggaggtaggattggggttgcccagatggagctgggggtcctgggtgggagcaaaggcaaatccagggtggtggcgtagacacagtattaaaaatactataacagaaacgtggaaagaaagaaaatatagaaccaccaaagatgagccagcaacaagagaagattcagacaaccaggtctttcagcagcgttggtgcctaattatttcaaaataaaaggtttttaaaaaaatgaccaaaaagggaaaaaaattacctgggaaaaaacaaacacttgtaattaaatatagatagaagcagctgggcaccatggctcacgcctgtaatcccaacactttaggaagccaaggtgggcggatcatttgaagtcaggagttcgagaccaacctggccaacatggtgaaaccccatctctactaaaatacaaaaattaggccagtcgcagtggctcacacctgtaatcccaacactttaggaggccgaggcaggcagatcacctgaggtcaggagtttgagaccagcctgaccaacatggagaaaccccgtctctactaaaaatacaaaattagcagggcatggtagcgcatgcctgtaatcccagctacttgggaaggctgaggcagaagaatcgcttgaacctgggaggcggaggttgcggtgagccgagatcgagccattgcactccagcctgggaaacagcagcgaaactccgtctcaaaaaaagaaaaaaaaaaggctgggcctggtggctcacacctgtaatccaagcactttgggaggccgaggcaggcagatcacgaggtcaggagatcgagaccatcctggctaacatggtgaaaccccgtctctactaaaaatacaaaaaaattagccaggcgtggtggcgggtgcctgtagtcccagctactctggaggctgaggcaggagaatggcgtgaacccgggaggcggagcttgcagtgagccaagatcacaccactgcactccagcctggtcgacagagtgagactccgtctcaaaaacaaacaaaaaacccccaaaaaattagctggcgtgatggcgcacgcctgtaatcccagctactcaggaggctgaggcaggagaatcacttgaacccaagaggcagaggttgcaatgagctgagatcgtgccactggactccagcctgggcgatagagggagacttcatctcaaaaaacaaacaaacaaataaacaaacaaaaaaacacaccaggcacagtggctcatgcctgtaatccagcactttgggaggccgaggcaggcagatcacaaggtcaggagatcgagaccatcctggctaacatggtgaaaccccatctctactaaaaatacaaaaaaaaaaaaaaaaaaaaaaattagccaggcgtggtggcaggtgcctgtagtcccagctggaggctgaggcaggataatggcgtaaacccaggaggtggagcttgcagtgagccgagatcgtgccactgcactccagcctgggcaacagagcgagactccgtctcaaaaaaaaaaaaaaattaaaaataaaagaaagaaaaaggaatattttgatacatgctatcaaatggatactctcaaaggattttcaagaaacattatgttaactgcaataagccggaaacaaaaggctgcatattatatgattccacttatatgatgtacttaccggcttcagatccagagtcaaaaagtagaaggttggtttccagggcctgggaggatgggggaatgggaaattgtataatggggacagagctttagtttgggaagatgaaaagagttctgaagatggatggtggtgatgactgtacaacagtgtgaacgtacttaatgccactgaactgtacagttaaaagtggttaaggccgggcgtggtggctcacacctgtaatcccagcactttgggaggccgaggtgggcggatcacctgaggccaggagtttgagaccagcctggacaacatggtgaaacccccatctctacaaaaaaaaaaaaaaaaattagctgggcatgttggtgggtgcctgtaatcccagctactcaggaggctgaggcgggagaatcactgaaacccgggaagcagaggcttcagtgagccaagattgtgccattgcactccagcctggacaacaagagcgaaattccgtctcaaaaaaaaaaaaaaaaaaaggcatttcacagaagaggaaacacaaaaggcagagtgtgcatggtatgggtttcctgtggctgcagtaacaaagtgccagagactgggaagtttaaagcaacagaaatttattctctcccagttctgaaggccagaagtccgaaatcaaggtggcaccagggtgggttccttctggggctgtgagggaaagccagctccaggcctgtcttctggcttcttccggtggttcccagcaatgctccgtgttccttggcttgcagaggtgtcattccaatctctgccttcagctgcgtgcagtgctctcctccctgtgtctgtctctttttctcctcctttaaaaacaccatgcattgattgaactaggggtcacccttatgcagtataacctcaccttaacttgattctgtctgcaatgacttttatggggacactactcaacccagtgcatatactctatgacctagcaattccccacctagttatatacctattgaaatgaacatctatgtttaacaaaagacacatacatcggctgggcgcagtggctcacgcccataatccaagcactcaggccgaggcgggcagatcttgaggtcaggagatagagaccatcctggctaacacagtgaaaccccgtctctactaaaaatacaaaaaattagctgggcatgggggtgggcacctgtagtcccagctactcagggggctgaggcaggagactggcgtgaacccggaaggcggagcttgcagtgagctgagatcatgccactgcactccagcctaggtgacagagcgagactccgtctcaaaaaaaaaaaaaaaaagaagaaaaagaaagacgtatacataattgttcacagcagcattagccataacagcccaaatgggaaaccaaccaaatgtcaacagttgaaggacacaatcaatggtgacgtattcatccaggggaatactatgcagcaacattgttacatgcagccacttgaattaatctgccaatgttgagcaaagaatctagacacaaaataatacttcccttcagagtggaggagaaggctgagtgcggtgactcacacctgtaatctcagcactttgggaggccaaggtgggtgggtcacctgaggttaggagttcaagaccagcctgaccaacatggtgaaatcccgtctctactaaatacaaaaaattagccgggcgtggtggcacatgcctgtaatcccagctactcgggaggctgaggcaggagaattgcttgaatccaaaggttgcagtgacccgagatggcgctattgcactccagcctgggcaacaagagccaaactctgtctccaaaaaaaaaaaaaaaaaaaagagtggaggagggaaaaatattatactgaataatttcctttatttaaagcctcaaaacagccaaaacaacacatcccatcatttttaggaatgcatgcttaactggtcaaactataaagaccaaagtgattagcataagaatcaagttcatggtcacattgggaagtgatagtaagggtatgagaggggctttcagggcaatgatattcaaattcttgacctgggtgatgccatggaactgtctgctttgataagcattacactgtacatctttattttgtgggtttttttttttttttttttttttttgagacagagtttcgctctgtcacccaggctggatggagtacaatggcatgatctctggtcactgcaacctctgcctcctgggttcaagcgattctcctgcctcagcctcccgagtagctgggattacaggcgcatgccaccatgcccggctaattatcttgtatttttaatagagacggggtttcaccatgttggccaggctggtctcgaactcctgccctcaggtgatccgcccgccttggcctcccaaagtgctgggattacaggcgtgagccaatgcgcctggcctacttcttttcttttttgggttacgtttcaccatagaagtgctttttttttttttttttgagacagagtctcgctctgtcgcccaggctggagtgcagtggcacgatctcggctcactgcaagccccatctcccgggttcacgccattctcctgcctcagcctcccgagtagctgggactacaggcgcccgccaccacgcctggctaatttttcatatttttagtagagatggggtttcaccgtgttagccaggatggtcttgatctcctgacctcgtgatccgcccgcctcggcctcccaaagtgctgggattacaggcatgagccaaagtgcccggccctttttttttttcttttttttgagatggagtttcgctcttgttgctcaggctggagtgcaatggcacgatctcggctcactgcaacctccgcctcccaggttcaagcaattgtcctgtctcagcctcctgagtagctgggactacaggtgcccgccaccacgcccagctaatttttgtatttttagtagagacggggttttgccatgtttgctaggctggtctcaaactcttgacctcaggttatctgcccgcctcagcctcccagtgttgggattacaggcgtgagccaccacgcccagccaggatttcaatgaacaaaatgcttttaccctaaagatgaagtccccagacagaaggtgctcattggtgctgtcaacatttggtgattggttcagtttagatatcacctcctggtgggagcagcttcatcggtgcccctctccttacatccctcccagtcccatgtctcaacctttggaatattcatgaccctgtatcatgacctgctgtcctgcatgtcctctagaccaaactgtcaacttccggggcagagtccaggtgcctggcccatagcaggtgcttcaggaagcctccagggccatcactccagggacccctagcaatgcagggaagaataaaagcagccacaggtgggtttcttccctaagcatggaagcagctcagcaacagagtcctggcggaggcaagattgccttccgcattccagaggaagtatttgccttgaaactatgtaacaaaagtaacagaaacataatagacatgctttcctttttaagtttgctggattctcctgggatacagtgaagctccagtgaaaacctctctcctcagctagttaaggcctggaaatggccacttgggggtttccctaagcacccgaaactcagtgagcccccaagtgacctcgtctcccagtccccaactcagagagacccaaaagctacaatcttctttgactgtattgtcagacccacttcctctctccagctcaactgccactatcctagtcctagtctgaatcacatgtgacaatcatgactacaatcttttttttttttttttttttgagatggactctcactctgtcgcccaggatggagtgcagtggcgcgatctcggcccactgcaacctccgcctcgcgggttcaagtgattctcctgcctcagcctcccgtgtaactgggactacaggtgtgcaccaccatgcccagctaatttttgtattttcagtagagatggggtttcaccatgttgtgcaggatggtctcgatctcttgacctcatgattcgcccgcctcgggctcccaaagtgctgggattacaggcgtgagccacagcgcccggcccgttagggtgtctttgatgccacgcttcgctctgggttttctccttcctctttgattgctccttgtccgatctcttttctggacccttctcctcctgcccaatgtaagtgctgggtgttcccctagatgctatcctgagcccgcttcactcctcgttctaagggattacagtctcctctcacctgtatcagggagggtccatctgcaggaaaaagacaccacttttgcaattttaaggaaaaggattaaaacagggattggccgggtgcggcgatgcgcgcctgtagtcccacttttccggaggctgaggcgggaggatcgcttgagcccggggactcgagaccagcctggccaacatagctagaccccgtctctaaagaaaaaaaaaagacaaaagaagagaacaacaacaaaaaaaccaaaataaaaataaaaataaaaacggacgggcgaacgcgtcgggtgggcgtagggttccgcgaagcctccctgtccctcttgtctcgtcctagtcggtctagctgggccccatcccctttcccactcggagcgtgagcgcctggagacacgtacagccaaccagtgagaaggagtggccgcgagtggcatgcacttggtccaattacctgcggccctgccggtcggcccgcgctggggccaatggaggtgcgaggcggggctcgggcgggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccaggtacctactgagtaccaagcactttggatatctgacttagtccaatatggtgggtggggattatcgtccctgtttgtttatagatgagaagactgaggctggaggttaagtgacttgtccaagctcatacagctaatgggtggcagagttgtaattctagctgtgatgatcataataatgataattggaaaatgctcacctgtttagtgctttgtaggcacttgctacactgatgtcattatcttggtttcactgccaaggaaagtaaggtttgtcgagatacaatgtttcactacagttgatagataccactttggttccagcctgagtctgccaatcctccctcccaattggagctcataacccgcatgctgttttccttcccatccaggatctttgccccaaaagcaggcgtggagaccatgagatgactctaagatagcaagtctctgctaggccctcccttgttggtggcctgtatggctcattgcccttgtagtctcccttggttgctgtgtgggcagatggtggtggcctgaagtcttttcaggaggtggtaaataatatagtcaaataggaactgagtcctagttctaccatgtaaccagccattggaggcatgaaataatctttgtgaatgacagtttctacatctgtaaaatgaagacaccacctatatcagagggctgtgagtgggaaatcttttttttttttttttttgagacggagtctcgctctgttgcccaggctggaatgcagtggtgcaatgtcagctcagctcactgcaccctccgcctcccgggttcaagcagttctctgcctcagcctcccgagtagctaggattacagggcgcccgccactacacccagctaatttttgtatttttttgtatttttagtagagatggggtttcaccatgttggccaggctggtcttgaactcctgacctcgtgatccacccacctcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaattcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgcgctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaaccatcccccccaaaaacaacaacaacaacaaaagccacctcatactcttagggagcagagacgctggctttggggtagaaaggcctggggcctgaatgtcaggggctggggtgtgggccattttcttggtgagcctttatgggtatggcttgccagaggagagctgccagagaggtgtggggggctgggccaggcccactggcccctggctaactcaccttttgcctctcccctgtccccagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccaggtactgcccgcatggcccagccaccagcctcggggcccagagagcagcaaggccctgggctatggcatgtggtggcaccgtttggctaaagatgccagtactccccaccccctcacagcccttccagaaggtgccctgtgtggccagaagaggaggggagggcctcttctgtgactcaggagttggtgcctagcactgagctgggcctccagagatgaggcagatgtgagccctgcgggtggggagccttctcacctagccaggcccttgtcacagagcaggtggccaggacttgagtgtgactgagaagcctcggggtgggatgggcttccaggagggggcactgaggtaagagtgtgcaggcttggtgcgtggggctagtggggaggagaagctggggtcggggaagggtagtgggcagtgcaggtccaggccgcctgaggactctggcgctctgtttgtcttccatagctctggtctgatggcacccagggaagtcctcacaggcaacggtgagtagaatcagggaggatgcacgtcctcatctagcccttgggtgggggccacagagagagctggcctgcagttcctcggcctcctcactcccagggtggcccgcctgcttctcggggcagctggcagtggagcagggaaatgctggctcccaggaccagccagggaccacctgacagaagaccctgtccagccagaccccacttggcagaggggggcggctctctgtgctggaggctgtggagccagtttctgtgcaggcagcgtgaatcctagagttatgggtttaataagactgcagacatttggaaaaacaattctggggactcatctatttgcaataaaggacagtcactccccatggaaaggcagtcgtgaacctttcatgggtggatgtggagttttctgtattgatatgtattttcttatgtcacataggtagggcttggcattagggaatcgatgactgaagccacagttgtctctgggggaggctgggaatgggggtgggatgagaagtagctgctcctaaggatcctcagtggaaagtaaacacaccactttcagatggtctagaaggtttctaaagcagacagtggggagtgtttctttatgcagggtgcctggtgacctgagtctctgctctccttgttgaccctcagatgaggtcatcgggcaggtcctgagcacactcaagtccgaagatgtcccatacacagcggccctcacagcggtccgcccttccagggtatgtgcccttccagcaggggctctggggcgtgcagggagaggcagtgtggtgagtctgcttggaggtggggagtgtatgccacaggtaggctgcccaggaggcccagcataggggaagcatgaggcacagaacccctgtggtgtgactatttggagtggctgactctgggggcagggctaggatgagcactcaagtcctgcctccccattccaggggcagctttccatctcgtcctgtgaggcttgtgggtggcagacttggacactaagtctaaatgaccctaagtttgagggactaggaatgtcatcagggtttagggggcatcagggaaggcttcctggaggaaaggtctcctctggctgatgggactttgagatagtggacagggtgtcctgttgggaggggaaggagggcacgacaattgggttcaagtgtgacactctcccagggctgctgaaagaaggctggttgggtgtttctgcaggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggcaagggcactaggctggggaggactgtgccaccacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgagcaaaacctctgggactttgtgtgggcaaataccaggccagctatctgagccatttatggggcaaccatgcccttctgtttgctctcgcccccaaagcccagcccaggcaccttagtgaccctaagagggagtaaaaggaggggcagtgagctcaggggaaccagaggaaggacccccatgctggtggcaagggggacctgggtcctggcttccagctctgttccgaccttgcaatgtgactggatcctcagttttcctatctgtcaagtggggacactgcttcttcaggtggctgcaaggacccaaggcagcttaggtaggagcagagctgaggaacttgttcctctaagatgccaaaggccctcccagagcctcacagtgcgcctctttctctggccccacaggctctcactgacctatgaacgactctttggtaccacagtgacattcaagtgagtcctgggggtggttgaggtatgggtgggctggtgtggccccagcctccccagctcacctgacatccctgccaccttccccaggttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgcgctgcccctgtcccagttcttgctgggcctcccaacggtcctttctgacccgtgtctgtgtgtctgccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcgttgggcctcttgtcgctcatttctgcgctgggctttaggcgcgtgctcgccggagggatgcgggaggatggagcctggcgagggggaggcgaagaggcatccgcggagaccgggaggggctttagcaagctgggccctaaccgctcagggtagggaggggcggtcgggccgagtcccggtgcgcttcggcgtctcaggaggccgtcgtgacaatggcagccttcgcgtcgtgagggggccgccccaggctgccgcagcggcgcgcgcccggccgcggggccgcgccgagactcccgggggggtgggcgggggtggggaggtgggcgggcgcgcgcggggcggggcggggcggggcgcggcgggtggggcggggcgcgcgcggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcacattcccgcaaccccacctcggttgcccatggagacctcaggctgggtagcatctgcagcctttgtccttgggctagtgacagtgactggtgagggtgtttatcttccccctttccccgaaaaccccgttggcctactcccctcagagactcttcttcctcggtccaggcccagatgcccctcctcagcggcaggggctcctgctatttgaagaaagagcagtccagggtggggcctacaatttcaaggactgtgctaagcctttcttttcctccctttcgagtgtcctttgcagtccagctgggtcttctctgtgccttattgtgttttatccgcctttttgtgcggctctgcgtaggtagatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggcgaggcaactagccagtggggatggtgggtggaaggagctgtccactgaggcaggtttgggtggggaacaaatcaggtctgctggtaggagcggaggcaggtgggagtgcagcggatggtgtcaccctcccccaggaatgcatcctgtcgggcatcatgtctgtgaacgggaagaaggtgctgcacatggaccggaacccctactacgggggcgagagctcctccatcacacccctggaggaggtgaggctgcccaggcccaagcctatccctgttaacctcccacatagcggcacagggtggaagtagctccccaggtgcctggagcaggaggaggtggtccctgaggtgtctctctctctcccttctgcttacagctgtataagcgttttcagttgctggaggggccccctgagtcgatgggccgaggccgagactggaatgttgacctgattcccaaattcctcatggctaacggtgagggacaggaaggaggtattgcaggtcgggggtgatagggaagacccgaggacggtcaggctccagaggaggcacggccagaccagctagagcctctggagagagccgtgctgatgttgcccttgtgcacccccacagggcagctggtaaagatgctactgtatacagaggtgactcgctacctggacttcaaggtggtggagggcagctttgtctacaaggggggcaagatctacaaagtgccgtccactgagactgaggccttggcttccagtgagtgtgggccccctgagccagagaaatcatggggtggcagggaagccaactgtctttgggatgggtggctgtccagaataaggcacccccttgtccaaagtcacatttcccgtgaaggaccagagaggcccttcactctgtattccctctgccccatgtcatgctgcacggctggctgccaggagggaggtcctcacacagcagggatgtgatgtggaggggaacggggctccttttgaaagacttgagcctggccaggtgcggtggctcacgcctgtaatcccagcactttgggaggcctaggcgggtggatcacgaggtcaggagttcaagaccagcctggccaacatggtgaaacaccgtctcatctcaaaatacgaaaaattagctgggtgtggtggcatgcacctgtaatcccagctactcgggaggctgaggcaagagaatggtttgcgcccgggaggcggaggttgtggtgagccgagatcacaccactgcactccagcctgggcgatagagggagactccatctcaaaaaaaaaaaacaaaaacttgagcctttggcagggcctccactgaatccccgagacatcgccaagtgtctgagccaggaaggcccttagagcccatccaggccaatcccctcttcatccaggtggggaaactgaggctaaaaagggtgaagaggttaacctaagatcacaggacagctgggctgtgagtgggggtgcctgccctgctgggatggagagttttgtgctgcattgatgcagaacctcctcccgccgcgttccttagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccagggttttgcaaggtgaggacatgggttttttcagttggcatagctgagtaggactagggccaggagtggagatggccgccttgagcattttcttggtagtatttcctcctttccaattcgtgctcttcatttacttcactccatccttgggtgatgagggcacaaccccagtgcactgaagtacagaagtctccacacttgaaaaaacgagtctccacaaatgtgacttgctcagttcccggcagcaccaggactgggcccagggtcccagaaccttgagtcagggcttagctgggagctgacctatctccagagagtccattctggtccctcaggctgtcttggtgcggagcactgatccctcatgccccctcccgctggcccttggcagtgtattctgagcagaagctccagagaggaaagagcccgcggagatggggccagcgttcacggcagtgacagagctgggatgaatcccggcgtctcctacctgctgcctgcctggggcagccttctttgcactttggtggaggaagggtgcagtggaattggtccccgtttctcctgggaggggccttcaccggagctgctctcaccacagattgagtgccatctatggggggacatatatgctgaacaaacctgtggatgacatcatcatggagaacggcaaggtggtgggcgtgaagtctgagggagaggtgagcccttcccgtgcatgcagtgcagtcccatggttgaggcggggcttggtcactttctctgtgctgtcgagtctcctgctgcacagccccaagggtcttggagctgggaactgggggtccagaagtcttcagagtcatgactgtgggtgagaggtctctttcagaggccacatgccatgtctgtggtgcagaaagtgttcttgatcacagtgcctctggggggcgggggggcgggcacccagcccgtgcgtcaaggcccacctatctgagcggcagggtagggccatgcattcaggaggggcagtagtgatggctccgaggaacgtcttgtctgccagagctgcctgcccttgctgtgagcgcagccccacgtctacctaagggagggatgtgacaggggcgaggacttctggtgccttctcaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcaggtaggccgggcgctggtacagcttcctctagggtgttctctttggggttactctttttctccccatcagtgtgggagctccctgccttacctctctggaaaaaaatttgagccacattgtagccaccacaacttggagccctagggtttgggtggcctggactctttccctctgggagggtggcggcttggatgctacctgctctgcggggctggggaggggcagtcgggccagacttgtgtccagccactggaacccctctctgcgtatggccagcgcctctggcctgagttgacggagctcttcctgtggccagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtgagggactgggctgagcccaagggggagagggagggagcccagcagctgggcttagggaccaggaagggcatggcccattgtgaggcctgtcccctcccctctgtctgcccctcaggtttgtggctatcagtgacttgtatgagcccattgatgatggttgtgagagccaggtaagcagctcgtcccagccctgggctcctggctgcccgcccaggatacctgtctgactcaccctgggcgctgggctctggctgtttccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaatctctggatcttgatggttatctcccaaaagctgggtacctggcagggctttggctgcctgggttggggctctggcttagcttcactctggactgtaaaaggtggcattcttcaccagggaattcctcacccagagcacgctggggccaaattgacttaaagcttaaggctacccagtgagtcgatgctggcaccaggactgcagccctcagtgctcaatgcagggggagtgtggtggagggcgggtgtcaacgtggaggaagcagagggagcgggggtcctggcctctggcttgaaaggagagggcagaggggaccaggggccagcctcggatgggattctaagtgaagcagggagacgggtgccagttttcggcttaatgcgggggaactagggcagccaggggaccagcgttggggtcaccaggaggaattagagggaccggggcccagccttggctcgggttaacgtcgaggcagcgcgaggggctggggaattcagcctccggggtccacaggagccggcggcgggggctggggcgggagtccacgcaggaccaggggcggtctccggcggggcggggcgggcggtggtcacgctccgggccagctggcgcgcggcggggcggggcatccgtgcgtctcctggtggctgacgtcacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggtgcgagccggggagcctcggagcatgcgcgctgcccaggtcccctggcggccccgcgccacgctccggccctggaagccctggggcggtggccacggagcgcgggcggcgcgccggggcaggcccctggctcgctgacttccagcagggcacacagaagcaagccagcgacagtctcatctgtgaaatgggcctggagccgggcgttctccgaggctgaggccactagctgatgaccggcctccggcaggagggagccgagccagtgtttctgttgggaggcacggcggggacgggcctctcgtcgcctcgcctgggcacccagcgtcctggctctggcccctcggccctcagagccaggcctctgccccctcggccctcagagccaggcctctgccctggtcctatggacaccgggcagggcggttcgtctccccctggagaggcggggaggcctgagccagacctggcaagtccactggccaggaggctccttccagaaccccttgcacctgtgaggcaggcacgaccctcccgggtgccagcggttcacccactgcttccgtgagtggcctgtgatggtggtggtcagggaaggagcgtggaggagcttgatccttttggggagactcactcatcaggactcggggctccaggggagagcaggctcctgcctggggaactggggaagcctggccagaggagccttgaaacaccaagtcctcatgccctggccgcactgtctgagccggggtgcccagcaagcagaaggtgtatttctctgccagccaccttcttgggagaccactggtcagcgagggcttgacatggtaccaagtgggttggggctggggccaaagagaggcctcctgggaagctgttgatgacattctggggcctggagggaggaaaatcactcagggaggggccaggcccctcaaccactctgttcttgtttgccctctcctcataacccttggcttgggtctcggaagcttcagcttaaaggctggagatgaaaaaggccaaaggtcagtagggtcggtggcttcaggctactgagggacctgtgatccccagcaggagacctgaagagccagagcagctcagggatggaaacagccccatttggcactcttagcatttgaagagccctgcccagcctcatggaaccttccatcgacaagggcacaggggcagatttggactataacgcaggtccttgatggccagcctgccatttccacagtgaggggtggttctcatggtggctgtcactccccgcaggagaacatcatgaaatccaacattgacaagaagttctctgcgcactacgacgcggtggaggcagagctcaagtccagcaccgtgggtgagcagggtgcgggtgcccctcacccgggccccgggccactcttccgctggccctgcgactaccttgccccttgtgcctccttgcttcaaaggtctcgtgaccctgaatgacatgaaggccaagcaggaggctctggtgaaggagcgggagaagcagctggccaagaaggagcagtccaaggagctgcagatgtgggtcctctcgccgcagccctcaacatggagctagtgcttacggggtcccgtggctggtcgggctctttttgcaccctgggggggaccctgtctccagctttgggacaggggtagcatctagcttgcgatttgcatttctctctcccgcctcctcgggtccacgctcacgtcttttcaccatggcggcttgtcttctttctgaccctctaaatgcagtgggccctttcccagcatccggtgcctgagcagcctgcgttctccccattgccagcctgtgcttggctctcccctgtggccctctgtgcttgctgtttgtaacagagccctcgcccatgagctcaaagtgatccaggacagcaggacccgtctggggcaatggggacccagcctgggctgggcaggccccacatagggcacacaggtggctctgggtcaaggaaggggctgggtcagggtcgggaaggacatgatgtgtgatggggccacctgcacctcactaggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaaggtgagggctggcttgagtcggagccccgcccgcagcccctggggaggggtccccaatgtgagaggctgtcagcaaagctgatgccctgtcaagatggctccaaaagctgccctcttgaggcaccgcgcacagtagaccggggagggaagaggctggtctagaccaggctggctgggcacattttctgtgatgatggaaatgttagagtctgtgccacccaatatggtagccacttgccccaggtgcctcgtatgactggggcactaaatggtgaattctgtttgatttgtttcagcgtaaatgtatacagccacagaaattccgaggctactagtcagacactgcaggtctcagctgtgagaacaaggggctgtcagggaaagctcaggatggctggggagtgagggtaaagccagcctggcctccacgtgtgccacacacctgtgctgtgcctggccagggcacatagggtgctgtccctctcctggtggaagtcacgggtcaccatgcactgaagacactactcagggttactgctctgctcggggcccaccgggctaacccaggggtcaaggaaggaggggagggttgagttaggccctaaggatgaggggagttgcattcgccagagaggcaggaggggcgacgagaaagtacatgccagaagcccagcaggaaagagcttttcaaaacgtttgaagattgggagcaagttgtgtcacgggcccctggagggtgtggtggcagttctggaaattgtgtcacccagggaatggcagagggagagaagcgaggcaggggatggtgctgtgtggctgtggtaacaggctgggtgccatggctttgaggggagtgcaggattgtagggaggaagaacctgccagccacctgccatttgggttccatgttccagcagccacagtaaaacatagaaaaagaaacaagcaggattttagtatgacattgtatttaacccagcgtatccaaaatatcaccattgcggcaggcgcactagctgcaatgctggggtgctgtgtgcagcgggagctactggtttgtgtttgtgtttttgttttggttgttgttgtttttgagacagtgtctccctgtggcccaggctggagtgcagaggggcgatcacagcttacttcagccttgacctcctggactcaagggaccctcccacctcagccacttgagtagctgggactacaggcgctttgtatttttgtattttttgtagagacggaatctcgccatgttgcccaagctggtctcgaacttgggagctactggcgtggacagtgcaggcctgggggaaaggttgtcaccctcactgtgtgtcactggggcttttacaaaacactgcttggtgggctcttccctccctccacaggttccgtttagggggcccagccacaagaccccaggctctagaatctctgcccttgagcatcaggctaaagagtttagatttgtctttttttgttgttcttttcttttttttctttcttttttttttttttgagatgaggtctcactctgttgcccaggctagagtgcagtggtttgatcacggctcactgcagccccgacctcgcaggctcaagcgatcctcccacctcagccttctgagtagctggtactacaggtgcgccaccacacccggctgatttttttgagttttagtagagacgaggtcttgctatgttgcccatgctggtctccacctcctgggctcaagtgatccttctgcctcatcctccccaagtgttgggttgacaagcgtgagcctctgtgcccgccctaggcttgtcttctagatcgactgttctcaaggtatgcttgggggaccctgggcgtcggccatatcaaaatcatttttataataatgctatgatattcggcttccttttgttccagagatcaccacgaagaagagaaaactggggaagaacccagacgttgacacaagcttcttgcctgatcgagaccgtgaggtaaaggctgcctggccctgaccccggcctcgactccagccctggtggagacccttgcttagggagccaggctctgcgtgcaccctgagcagccctgggcctcacctgtctgcctgctccctctcccaggaggaggagaatcggcttcgggaagagctgcggcaggagtgggaagccaagcaggagaagatcaagagtgagtgtttgcggagtcagacgcgaggggcctgggcccaagccagcttccctgtccacagtctcctgggtggtgcgctgagccccaaggctgctctcagtggggctggagaccaagaggcagctctgccttgtaggtgaggagatcgagatcaccttcagctactgggatggctctgggcaccggcggacagtcaaggtaggcagcgtgcagcctgcttcctgctcaccatgggcccagcctccctcaggttccgtgggaaggaactgaccttcctgacttgggaagccccagggatcctgaggataactggctccagggcctggccccctgtctggggagtgaggcccaggcctggctgaggctctgcagcgtctggcagggccctctgggcctctgccttgttgagagcccttctgcaggcttccgccttcccttcccaactcctggattcccggatacagatgagaaagggcaacaccatgcagcagttcctgcagaaggcgctcgagatccttcggaaagacttcagtgagctgaggtgtgaggtgtgcgtgtgtgcacggtggtgtgtgtggcacctgtggctccagcctgggtgccagacacccagtgtgatgtgggcgctgtctgggcaagcaagcagcgtgctgggcactctcctcccaaaagagggggtcaggctcctcttcccttccctcccaccagagagctttgctgagagcggcctgccttggttccttagcccaaaggtggagggtgctgggcgccagtcctgtgctcactaaaccatggagcttccctcacagccaactggccgctgcttcccagccccagcatgggctctcctgggctggctgtctcctccctccctgggcaggggtgctgtcctcttgcccacgccctcctgccttcctccctcaggtccgcaggggtggagcagctcatgtacatcaaggaggacttgatcatccctcacgtgagtcccttcagccccagtacccgcagtgggtgcagcaccctgggctttggctcaggctggtgggggcagtgtgcgcaggcggggggtgtggggaggggccgagatggaccatcaagacgccgctttcctgcccttggctcccagcatcacagcttctacgacttcatcgtcaccaaggcacgggggaagagtggtgagtgccgccgacccagccgcccccatagcaccttgccgccgatgttgtcactggggcagcagcgggacattgggctgtcacttctcccctgcaggaccactcttcaactttgatgttcatgacgatgtgcggttgctcagtgacgccactgtggagaaggatgaggtacagcgtagggggccgtgtgagggggaacgggtgtccctgggctatggaggagaagccaagggaaggggaggtcagcaggcggccctgtgccctcttcctcccttagtcccatgcaggcaaggtggtgctgaggagctggtacgagaagaacaagcacatctttcccgccagccgctgggaaccctacgaccctgaaaagaagtgggacaagtacacggtgaggaggggctggcagggacccctccaagttggggacggcagccagcccctgctcacccctcgccttccttgtctcctctgcccaccttgtcctcacactagatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaaccatttgtgttcggaccaaattcatttgtcattttgaccatttaaaactgtacaatttggtggcatttagcacatttgccatgttgtgtagtcatcaccctggtctgcttccaggacattctcatccctccaaaggccctgtggccataggcaggctcctcccctcacatccccccaccaggctctcatgtgctttctgtctccatggattgacctgttctggacgtgtcatacgtgcctggggagtctgtcaccgtggcagccccaccatccctgaggtgtctttgtggcactgtgcttcttgaccgtgggcacctgtccttgggcggtggtggctctggtgggtgggaagggggttcctccccaggcctctctcccaggcccttgggctcctgttgagtttcccgtaggggacgtggccgtcctgtggccacgaaaacccatcctgccttccttgctgtgggccgtcccagcacagtcgttctgctgtggtgccctgtgctcgacacttgcctgccctgccctagctagccctgctcagacagcccttggggcaggatccagatcgggggtaggtccaggacccctactctgccacctcagcagctgattccccaagttccacttggctaagctgaggcaggcaggcctggctccaggaggctgaggaaggccagctgacagctccctgtttcctcccctggcctgaagccaagaagaaagggcaggggatagcccctcactggccaggatcaccccagccctgggtctggcctccccttcctggcaaatgtggagatctgatggtgcccgatagtgcagaggcccagtgtctcattcagcgtggccgggaagtagccacctggcgtcactaggaatagagatgagagtagactaatgttttctttcttttcttttccttccctccttccttccttcttccttccttccttccttctttcttccctcccctcccctcccctctccttcctttcctctttcttttttttttttgagactgggtcttgctctgtctcccaggctggagtgcagtggtgcaatctcagctcgctgcagcccccacctcctgggctcaagtgatcctcccgcctcagcctcctgagtagctgggactacaggtgtgcaccacaatgcccagctatttttatttttatgtacatgaaaattggaacagaattaaaaaaaaattttttttgtagagatgggatattgctctgttgcccaggctggtctcgaactgctgggctcaagtgatcctgccacctcagcctcccaaattgctgggattgcaggtgtgagccactgtgtttggctgagtaggctatttgatgctctggaaccagataaggtcaccaaggatcagtgtgtgccaggggtggtcacccactttgctcacccgggcctcgttcctgggggctgtgtgtgtagaaaacagagagggaaacaaacaaaacaaaatgtagaacaagatgagctggcctttgtggcgtggagacatttaagctgacatccaaatgacaagaagtcagccattccgatgcgggagggagtgttccaggcagagggaacaccaagtctgggtcaaaagtgagctggaggccgggtgcagtggctcatgcctgtaatcccagcactttgggaggctgaggcgggtggatcacttgaggtcgggagttcgagaccagcctgaccaacatggtgaaaccccgtctctactaaaaatacaaaaattagctgggcgtggtggcaggtgcctgttatctcagctactcaggaggctgaagcaggagaatcgcttgaacccgggaggcggatgttgcagtgagccgaaatcacggcaccgcattccagcctggatgacaagagagaaacgccgtctcaaaaaaaaaaaaaaaaagaaagaaaaaaggtgagctgggctggaacaaggggaagctacctttttccctcatcttcactgtccagcagaagccatgtattcaggcggttcccatgtcagcatggaagccagttcctgcaatgtccccaacagagatgtgcttttcttcactgcctgcttacctgttctctttctctagacaaagacaagctcctacggctgctcctcctggccctcacctttctcgcatgaaaggtattgcgcttgcatgctgttcgacaccgtgtgatatagtgtccattagcgatatatcccaatactcggcatctttccacatgggtgcatagagaccctcattctctcttcagctgcagagtcagcatggcagatattggccaactccactccttagggcctgcccacttggcagcctcatgggcaggatgagggccggctcccccagccttgcccacacagtgccctcactcgccgccaggagacgcgtgccaagctgagatggagacatggtttctcagcatggggttttgtttcttctttgtgtttttaattttttcaactgaggaaaaattcacataacagaaaagtagccattaaccattttaaagtttacaatttggtggcatttggtacattcacattgttgtgtgaccattgcctctctctactggaacattttcatccccaaaaggagaccccgtggttggttattcagcagtctctccccattcccccactccccaggccctggcagctgctaatctaccgtttcaatggattggactgttctggaagcttcacatcaatggaatcatacaatacatgaccttttgtgtctggcttgtttttcttagcatcatgtttttgaggttcatggcttactttttataactaactgagtcgtagtccattatctgtgtacaccacatcttgtttatctattcatccatggatgggcatttcaggtgttcctacctttcggctattattgtaaataatgctgctatgaacattcacgtacaagtttttgtttgaccttagtgtggtttttaatttgtatttctcttttcacatgtttaaaaactatgtgcattttatttctcctgcaaactgtctattcctggcatttgcccattaattgtattgttggtcttctttgtttttttttttttttttttttaatagagacaggatctcactatgttgcccaggctggttttgaaatcttgggctcaagcaatcctcctgccttggcctcttgttggtctttttttatctagaaatcggtcaggtgcagtggctcccgcctgtaatcccagcactttgggaggccgaggtgggcagatcacctgaggtcaggagttcgagaccagcctggccaacatggtgaagccccgtctctactaaaaatacaaaaattagccgggcgtggtggtgggcacctgtaatctcagctgctcaggaagctgaggcaggagaatagcgtgaactcaggaggcggaggttgcggtgagccgagatcgtaccactgtactccagcctgggtgacagagcgaaactctgtctcaaataaataaataaataatatgtagaatcctaggtaccttccatgtatgagagagagtacccctttgtgttatacagtgcaaatacttttcctcgtttttcattgatttgatggtgttttttagacacgagaagtttatttttagctagctggactcttttgtcttctatgccttctgggtttgaggtcatagttagaaggtcttctggaagtcagtgttataaaggaagtgattggaggcttttaccaggagcaagacataatcttgacttaagttttccagtcactcttgtagcagtgtggcaaagggactgggggagggcaagcatgggaggccagtgaggaggccaccacagctatcctgatgagaggctggtggcttggaccagggtggggacagaatatcagcttctggatagattttggggggaaagccaacaagatttgctgacgaataggacatggagtttgagagaaagagaggagtcaagaactccactttggcctgagcaagaggaataaactttactaagatgcggggcatgggaagagaagcaagtctggggtgaacaatgaaggctttgcttgtggaaatggtatgttgagatgcctgttagatccaagcagagatttggatctatgaacctggagcctggagttcacaggagagcttgagaggatggagtgagaaattgcagagctgtcaagacagacatggctgatgctctggaactagaaagatcgccaagggaatcaaagggtaacacctgctcgtctggtcaagccaatggatgagatgacaaagatgggactaaggccaggcacagtggctcacgcctgtaatcccagcactttgggaggcctaggcaggtggattgtttgagcccaggagttcgagaccagctgggcaacatagtgagactctgtgtgtatagcaaatacaaagattagctgggtgtggtggcacacgcctgtagtcccagctacttgggaggcttaggtgggcggatcacttgagcccaggaggtggagaccagcctgggcaacatggtgaaaccctgtctctacaaaaaattcaaaaattagcctggcgtggtggcatgcacctgtagtcctagctacttgggaggctgaggtgggaagattgcttgagcctgggaagacgaggctgcagtgagtggtgttcataccactgcactccagcctgggtgacaaagtgagacattgtctccaaaaagatcattatacaaaaatcaatttttaaaagttttttgagatagagtcttgctctctgttgcctaggctggagtgcaatggcatgatcttggctcactgcaacctctgcctcttgggttcaagcgattgcccccctcctcagcctcccaagtaactgggattacaggtgcccgccaccatgcctggccaattttcgtatttttagtagagacggggttttgtcatcttggccaggctggtctcgaattcctgatctcaagtgatccgcccacctctgcctcccaaagtgcttgaattgcaggcatgagccaccacacctggccaatcaattgtatttctatacacaatccaaaatgaaattaagaaaataattccatttataacagtgtcaaaaaagaataaaatacttattaatagatttttttaaaagaagcatgagatttgtacactgaaaagtacaaaacatcattgaaagaaattcaagaagacctaaataaatggaaagacatctgtattagtcatggttctccagagaaacagaaccaacaggacacacacacacacagtttattttaaggatttggttcacccaattgtcggggctgacaagttggtgtgaaatttgtaggacagactgacgggctggaaactcggagaatttctgtgttacagtcttgttgttgttgttgttgagatggagtctcactcttgtcgcccaggctggagtgcagtggcatgatatcagctcactgcaaccactgcctcctgggttcaagcgattctcctgcctcagcttcccgagtagctgggattacagatgcccgccaccatgcccaactaatttttgtatttttagtagagacggggtttcatcacgttggtcaggctggtctcgaactcctgacctcaggcgatccgcctgccttggcctcccaaagtgctgggatgacagacatgagccaccgcgcctggcctgtgttacagtcttgaggcagaatttctgcttctccaggaaacctcgggttttgctcttaaagccatccaactaaatggatgaggcccacacacattatcaagggtgatctcttttacttaaagtcagttgagggccaggcatggtggctcatgcctataatctcagtgcttttttttttttagacagagtcttgctctatctcccaggctggagtgcaatggcacgatcttggctcactgcaacctccccctcccaggttcaagagattctcggccgggcgcggtggctcacgcctgtaatcccagcactttgggaggccgagatgggcggatcacaaggtcaggagatcgagaccatcctggctaacacggtgaaacctcgtctctaccaaaaatacaaaaaaattagccgggcgtggtggcgagtgcctgtagtcccagctacttgggaggctgagacaggagaatggcgtgaacccgggaggcggagcttgcagtgagccgaggtcacaccactgcactccagccttggcgacagagcaagactttgtctaaaaaaaaaaaaaaaaaaattctcctgcttcagcctcctgagtagctgggactacaggcatatgacaccatgtccggctaatttttgtattttttgtagagatggggttttgccatgttggccaggctggtctcgaactcctgacctcaggtgatccgctcacttcagccttccaaaatgctgggattacaggcttgagtcactgcacccagcatatgccagtactttggaaggctgaggcaggaggattacttaagcccaggagttcaagactagcctgggcagtgtagcaagaccctgtctctctctacaagaataggaaaagttagccaggcgtggtggcacttgcctgtggtcccagctacctgggaggctgaggcaggaggatcccttgagcccaggaagtcgaggctgcagtgagccatgatccaatgccgctacactgcagcctgggtgatagagcgcgacctcaacttggggggaaaaatctgtctatctatctatctctccatatatgtgtttaataaaaatgggcaaatgacttgaatagacatttcttcagagatcatatacaaaaggccagcaagcacatgaaaagatgctgaacaccattagtcatcagggaaatgaaaaagaaaaccttaacggggcgcggtggctcacacctgtagtcccagcactttgggaggctgaggcgggagcatcgtttgagcctggggcggtcgaggctgcagtgagctatgatctcaccactgcactccagcccgggtgacagagcgagaccctgtgtcaaaagaaaacaaaaaaagaaaaggaaaaagaaagcaagggaaggaagaaagccctcggttcagggtcgccggggaaggggctggtttggacggctgtcccgcaggccctccgggttagagaccgtcgggggcgtgtcttgagctggggacgcgactcctcggcgggggtgcacctgagaggccgggaccagcgaggccgcgccccggtggcaggtgaccccgggcgcgtctccgagcgccagggtggggcgaggcggacgcgcgccccaggcccgagggggtgtggcgcgggcgcgcgcgggttccggggtcgcccgaggcggcgggcggggagccggggcgcgggggaggcgcgcgccgcggacgcggccatcgagcgaagggggtcggctggccgggcgggtcccccttcaggtcgcgggggtcagggctgcgcgcgaggtccctggccccggggagcagcggccccgcctgcgtcccctgccgccgcgtccccctcggccgggcgtccccggacgcccccgccccgcgcggtggtacggtccgggtttaaaaggctccggcggcccccgggccagcccagtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggtaggtggccgtcatcgtcgccgtccgtgcggggccaaacagctcggggcccggggctccggcagcccgggggtccggctcggcctgtgggggtcaggccctatccctgcccgtcggcgccggcctgcccgactccttgtgccccgcatggtggggacgccaacccaagaccaacaccctgcccaaagaggaccctttgtcgcaggggagcggcccctcggaggatcaacgctgtacttccctcccgctaagggctccgcgagtccgccgaggggtgccctgatggggcccgggcaaaccggaccagcagcacggtggggggtgtggggggcggccgctggacccccgtctctgcgtggggctgccccttcctcaggctctctgctggcccagctgtacctgtgatgcccgaggttgccacttacaggtgggggctgggcctgaaactgcctccccaggtctccctcccgacctgtccccagcctgttcctaggcttgtgttcccggggtgtagaggaggtgaagacaggatgtggcctctcttttctttggccttcctttcttctccggctgttgcatgaggggtccagctgacaaaagagccctggagaggtgatcaatctgagctgaaactttgcagtttcaagctgggcccgctgcttgttcctggcaaatgccttatttttcctttctctctcctgtgcctccttggtttggttccctgcaccaccccccgctccccccccgcctcccgccctcaagctgggtacctcctatctcccccgggagctctggcactgagagggtagcgctgagccctgccctgttggctgccacgacactgctctgctgtcttagcagcctggggctgactgggtgtggcctggggactaagtgccagtcccagcactgtccctgtggctcctgccctgtctctccaaggccttgactgtatttggggacattgctcctcctcttgtaaggctcctgggactccaaagggcaggtagggccccctgtacattcccttctccagtgaacccctgggtctggagggggagccatgcaggctgtggctgagcagagcttgactgatgtgtgtctgggtgcgtggctgaggggcaggcgcgacttggctttgtgttgcatcggggaggccagacagcgggctcctggatggccagctgaggcccttgtcggggaggcagctggggcccctgcaggggacatggtggtgctggatcctgcatcaggcctccattccccagacctctgtcccagggctcctggtggcagtgccactccaggtggtgttcctggccctgcccctctcccccagcttgcgattattctgtgcctgcctccctctcccctcagctcaggcgttgggggcagcccagaggcctggggcttgctgttctttgctgttggttgccccgggctctgagatgtggcatctggggtcccagttccagcatctgctctgctacccccttgggtgtggcccagctgaggcgaggcctcctggctcctttccagcatgggggctgagggacgattgatggcccccaagcctgccctcgctggctgctcactcatgcgccctggcggaggcccctcctctctccctgtcacggtggccatctggggctttggcggggtggtgggtgaatggcccagccctctgtggctcgaggcctctgactcccacacaccgtctctccctaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgcgtgagccttccttctcttcttcctccacccagtcctggctctgcctcccagaagagccctgttctttctgagaggggactttcggctcctcagtgtctgggatgcagacaggttgcggagggtgggatgacagcctgaacccaggttgcgggggtcccctgtgtgcagggaggctggtcaccctgccctctgcagcctttctggcctgggcctctgtgatcatccaggcgggagggggatgcagagggaagctggcggtggcccgtgatgttggcacagggcctcaccggatgctgtctcctccccctgctccccaggtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacaccgtgagcccctcatcaccccacactggtcctctgccctgtcccaggtctaccatgcccagcgtgggctcacggccagtcatcctgtcccaggctttgccatggccctgggagtggcacctttgccctcccacctgtttctccctcccaggggtccctgccctctccttgcctctctctgggctgcccagtgccccacttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctctgttgaatgaacaagggagcaaatgccttgcccctcaagcctccctatgcctgggacagacccacttgcccctgccctctccttggctcactacttcccatccttcccctcctacccatgggcccgggggctgaagctgcttccattggggatctgggggtagcttggcatgaagggggagatgaacttctgggcactcaggtacgtgttgaataggtaggagtcgggggactgcagtgctctcatcctgcttgcctcgtagatgcagtgccatcccccaggagggcaagtgttggtctgggggcgcagggaagggtttgtggagaaggatgatgaactctcctggcccacctgctctgttcctgggaccctcttttcctttgtagcagctttgttgaacgcgtactatccaattcacccattttaaagtgcacagttcagtgggtttctgtggatctgcagagtggcacaaccatcgccactacctcattctcctaatcaatgccatcttctagctcttcccctcccctgcatcccctgaccttgggcaacacgaatcactccgtccttctgtttgctgagggcattttctggcgtctgcaccctcctttttttggcctccgggctgtgggtgtgagtgctgaaccccaccaggtcctgacgtcagctcagccacaacctccaaagtctttggctggagaagacagtgtcccaggtgcaggaggctgtggtggcatcaggctggtcttgtggctcaggtgcgggtcgatggcttccaggatgcccacctgtatgagacagtccccgtggtggatggcagccccatcctccgagacctgctcttcagcccggaccaccggcacatctatctcctgagtgagaagcaggtgggcctgtggtgggtggcggtggctggtggggcgggggtgggctgggtgctgatgtggctgtccccaggtgagccagctcccggtggagacctgtgagcagtaccagagctgcgcagcctgcctgggctccggggacccgcactgtggttggtgtgtgctgcgacacaggtgagggcgggggcccctgctcggggagttggagggccccactggccagggggagccagccacacccagccgtgcccttgcggcctccccccgccctcctccactttctccagctaatgagtggaacctccaccccgagtgacgtccctcgggccccaggggacgcggccaaggctcgctgttgcctggcactgtgagctggacaggcctgggccctcccggggcagtggcgggaccggctctggcccgaccccgtgcaggtgctgccgcgaaggggcctgtctgggcgcctctgccccacacggctttgctgaggagctgagcaagtgtgtccaggtgcgggtccggcccaacaatgtgtcagtgacgtcacctggggtgcaggtgagcagcttgggggtgcccggctgggtgtgcacatgtgtgctgggagtccgccctgccctgagccctctgcttcccccagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggtcagtgggttggggctgcccaggatggggcagagtggggcctctccctacccccagcgagttcacggccaccccgggactgctgcaggggccacccgcactgtgcggctgcagcttctctccaaggagacaggcgtgaggtttgccggtgctgactttgtcttctacaactgcagcgtcctccagtcgtgagtacctggccagcacccgtccctacccctggggatagaggggacctctgggacaggcgacaccttcagggcagctgtttctggggcatcaggggctaactgtcaggccctgatagcccctgacatccccacatctctctgtcccctgatatggctgccttcttccttcagttcccgatgtgtcctattggggagcagtgaggggcagtgcagcctcctctgttatttctgaagccacttcccccccaggtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcggtgaggtcccacccgctgcctcccttcggggtctgggctgtggcgtggtgtggatcgttcttgtctatgcccagctctctggcagggaactgtctgagtctcctgctagggattcctgtacctggaggaggggggcagctggcaaaaatcttgggtaggggttctgcacatcttatctggggtcccatgggttcctttcctccagtactcctatgaaggtgatgagcatggtgacaccgagctggacttctccgtggtctgggatggagacttccccatagacaagcctcccagcttccgaggtgaaggcatgggccagggagcttccctcctaaggcaattggcactgctggggtcgggtctgggggccctagtgctccccactttccacttttctgccactgcctgctccgtcagcagtgccttctgtgcctgcagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcaggtcagcctccctcaccgcccctgcccactgccaacagggcccctgggagtctgagccaactctctcactgcccatcctgctccacagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggtgagtgcggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtggtgcgtggctgccggccctaccccttcctgtcccttctctctcccgcaaggggcgtgtggagcagcccggcccggctcctcccctcagggcagcttctcccgcagaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggtgggccggggccctgccagctttgggttgggcatcgtgtggggggccgtggggacgggtggctgagggccctgggccacccgctccaagcaccctgcttgccaatgtaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaagtaagaccctgggggactggggagcctggcagtgtccagagggctcagggactgggtggtctctgagctccggtggggcccctcctggagcctaggccctcattggtggagggggtggagctgtcctggctgcacagtacccggcacccactaggcgatccagggtcagggaaggcctgggctgccatggcagccttgatcgctctccagggctgggtgggtgcactggaggagggagcctgaggcccctgccctgtccctagtggaagcactgccatcactgtgagtgggacccacctgctgacggtccaggagccccgggtccgtgccaagtaccgcggcattgagaccaccaatgtgagtaccagctgccccgccccaccccgaccctgcagcccatggcttcacgtgcctggctgtccacctttgtccccacagacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaaggtgcgggcggggtgggggcggggaggggcgggaaagtggagagtcctgggctgaagttgtcctccacccccagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtaggtggggatggggagaccccctgggcagcccagggtgggcgtggtggtcagctcacctcaggcctgtccccacaggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaaggtgcctgaggcggggcgggatgtggtgtggaagctggggacctccctcctgcccactcattccctctctccaccccccagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatgtgagcctctgcctggcctgccccccaccattcccttcagggccgcccccaccctctgagacctcctgctccccacagacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggtacctgcctcgctctatccaggccacacctttgtcctgcctgggcctgccccctgtccaagccccacccctgccaggcccgagcccccttctcttgccctaggacagagtcagtggctgagaagatgcttaccaactggttcacgttcctgctgcataagtttctgaaggtgcgccaggtgggtgggcggcagggaggtggtggcagaggaccggccagtggtcaggcaggcagccagctgtgcacctgtccctggctgcaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactggtgagcgcagggccaggcgggccagaggtaggggcgcagagagaggcctcgccccagactgacactggagtccgctttcccctcagacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctgggtgaggtccccaccctctcctcctggctcccactcataccctcctgtgccgtgtgacctccgtgggctctcccgctccccacctgaaccctgtttcctaagaggagtgggccaggcacttgggggctgccagcataatcttaagggctgtctgtggcccacagagtggcgccagggccgcatgactcgcatcatcctccaggatgaggatgtcaccaccaagatcgagtgtgactggaagaggctcaactcactggcccactaccaggtgaggggttggggcccattcctccccagggccacctgggagccaggaccctgccttgagctgcagcaggacacgggagcagtggccctggctcccctcgcccttctccctgggctcgtgggctcccctcctgggtgtgggtgggtgggggcgccttggcttctcagcttcctgcactgcccccctctgtctctggggcctccaggtgacagacggttccttggtggcattggtgcccaaacaagtgtctgcctataacatggccaactccttcaccttcacccgctccctcagccgctacggtaggtgtcctcagtgtggtggccatgtgcccttcgagggaacccccacttccaagtgccatcgattctgtagagtgtagacggagggtcggccagcgagggcagatgggtccccacatgctgctgagctcccgggagagtggggcaggggccaggtggtggcctaagggtcacatgcattctctgctccagagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaaggtatgggcctgcctctcgccaccttggcctccgcccagaggttgtcccggccttacaggggaggggccatggatcatttgcttccagtgggcctttcttcgggtctttgctgtgggaactctgagccttagataaaggccatgtctgtctgagagaccactggccctgtagggaagcccctctctttgccaagcctttctgcctccatctgtcctgctctggggacatcccgacctggctccctcatagcctgtgacctctctgccccacacagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatccaggcaggagggaatgaggcctggcctggggttgacactgacggtgccatcaagccaaggggcctgttgcgtccagttctggagctggactgcctgggtgggtgggatggtggtggtgaggcctttgccctctggggtcttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtgggctccgccctgctgtgggtggcagagggcaggacctgcccctccctgggctgcctgtgcgaggcaggccagctacaggcaggaagcccgggggctggctgggcagtgagggcaggggttctagtttttgtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactttaggatggagtctgggctggacacatttgcaagcctgtggatggcatttaaagccctgagcctggatgagctcacagggaagccacaagtgggtgtggagggagaagcggcccaaacactgagcccagggccccaggacacaaagaggggaggggaggggaggtgcagcagccagcggggaggatgcctgagagcgcctggtggggtctggcaacctgagccagtgaggacccctcacaggtcagggagtggcagtggccggctccatcttccagtgctgctgctggtgaaggatggtgacctgcagaacactcactgggtctggcgagggtcacggggtcctggcgcgagggaggcttgggctaggaggtaatgggagggggaatccagcacggcgagtccagagtccaggtcactctagggacaggccgcaccctagctgtggagaggaggaggagaaagtgctgtcgtcggaggggcatttggggctggggagagctggtgggtttgtacaggggctgcgggggaggacggagggatgaggcgtgtgggagggaggagcccagctgggaagtggggactttgcatggcaggagctgcgccccctacagagcccagctccaggggactcctctcccccagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctcccttccaccacccccacccagctctcctgtgccatcgtctatctctgcctggatgccagtctccctgcttctgccctggctctcttcagcctgttctcagcgtgggaggcagagagatcctgttatgatataaggtggatcatgttgcctcactgtttagaaccctccggcggtttcagctgcagccagctccttcaaaacctgacaattgcatactgtcgaggttgtggcacccatcatggtgcacctaccaaagtcttactcccaggcctgttaagtaatgcaggtggggagaaggtgacatgcaatttatttatttatttattttgagacagagtgtagctgtgttgcccaggctggagtgcagtggcaagatcacagctcagtgcagtctcaaactcctgggctcaagtgatcctcccacctcagcctcctgaatagctgggtgtattagtgcactctactatgccaggcttttttttttttttttttgagataggttgccgctatgttgttcaggctggtcttgaattcctggtctcaagtgatcctcacccctcagcctcccaaagtattgggattacaggcatgagccactgtgcccggccaggtgagatggaatcttatttttactttttatgtttttttttttttctttgacggagtgtcgctctgtcgcccaggctggagtgcagtggcatgatctcggctcactgcaagctccgcctcccaggttcacgccattctcctgcctcagcctcccgaatagctggaactacaggtgcccaccaccacgcccggctaattttttgtatttttagtagagacggggttttactgtgttagccaggatggtctcaatctcctgacctcgtgatccacctgcctcagcctcccaaagtgctgggattacaggcgtgagccaccatgcctgaccttttttttttttttttttttttttttttggagacgggatcttgccctgttgcccacgctggagtgcagtggcaaaatcaactcactgcagccttgatgtcctgggctcaagtgatcttcctgcctcagccttctgagtagctaggattacaagtgcttgccaccatacccagctgtttttttttttttttttttttctttagtagagatggagtcttgctggttttgaacctcctgggctcaagtgatcctcctgttttggcctcccaaaattctgggattacagttgtgagccactgtgcccagccaagtgagatgcaatttttttttttttttttttgagacagagtttcactcttgttgcccaggctggagtgcaatggtatgatcttggctcaccgcaacctccgcctcccgggttcaagtgattctcctgcctcagcctcctgagtagctgagattacaggcatgtgccaccacgcccagctaattttgtatttttagtagagacagggtttctccatgttggtcaggctggtctcgagctcccgacctcaggtgatccgcccgcctcagcctcccaaagtgctgggattacaggcatgagccactgttcctggcctttcttctttttttgtttttgtttttttttgagatgcaattttaaatagggtggcttggacagccacctgagttgggtttaaaagctgccagctccagccgtccagctgtggggccacggtgccagacagtggtggtggttataggaccgtaggtgtttaccaaaactagacaagtccacataacaaccaactgcacaaataaggagtaaaataataaagagaaggacgtgtgaggcaggactggattgtagcccaggataaagagaagttgcgggatgacagctgtgccgtcggcccagacagaaccatctggacagaggacagaggataagggagatggttgaaaatactaccatcatatgataatgacaactaagccacaggaaaacaaggcagttttaacctcaggggaaatccctcagaaatggatggaatctaccagaagcatcatgagaggaagaggaagggaaacagagctaaattggggccaggtgtggtggctcgcacttgtcatcccagcacttttggaggcccaggcgggaagatcactggagcccaggagttcaggaccagcctgggcaacaaagcgagatcccctctctacaaaaaataaaaaactagccaggcatggtggtgcatgcctgtggtcccagttactcaggaggctgaggtgctggggaacaaggctgcagtgagctgtgattgtgccagcctaggtgacagagccagaccctgtatcaaaaaaaataataataattaaaaaacaaaagatcggctgggcgcggtggctcatgcctgtaatcccagcactttgggaggctgaggtgggtggaccacctgaggtcgggagttcgagaccagcctcaccaacatggagaaaccctgtgtctactaaaaatacaaaattagctgggcgtggtggtgcatgcctgtaattctagctacttgggaggctgaggcaggagaattcgcttgaacccgggaagtggaggttgcggtgagccaagatcgcaccattgcactccagcctgggcaacaagagtgaaacactgtctcaaaaaaaaaaaaaaaaaagtgaaagatctaaattgtcaactattcgtcaataattaatgtctaaaaaatattaagaaaggaagaaaggaatgagagcaaaagagagggagagaggaaagtgtcatcttcataagctgaaggccagtgccaccgtcaccactggcagagctccccagattctacaaagggaaactgttcctccatatggagtaatagggactggatatgtcatgccaaatgaaagaacacgccaaaccagacaaaatatatggaatgcagagtattaaaaaactggctgtgggccagtgagggacagcgacgtgtgggagctgggaaacaaggtaagccatgcgactggcccagtgtcctgtgtggagtttcctggtggagcctggcagacacccggactttaggagttgaaactgattcagagcgtcccagcagctggagtttgcagggcggagaaccagagagaagagagctgcacagggaaagaaccctggatatccacagaggctcccgttccagtgtgcagcggactacgactactggtgagcacaggcgtgtgaggaagctacccaagaccagggaaggccatcaccccagcaggagaggatgaacggtaactccagtgtgcaagcaggacagggactagcagctgtccccacccaccaggatagagaagctcatgttcacctaggcagcactggccagggtgcccagaatggtgtttgttgcctccatagagggaaacaagcctacagttaagagctgctctggtcccacacagcacatcttcaaagcaagactcaaaaggatcaaaccatttccttgttttctgagaataaaagcagttgtacctcttccttttcactctcagaaaatctgatagaatctataaaagagccctaaggctggagacactgtattttccagggagccaactccttgccccagacactagtcaattgccccagcactttcttcactgatcgttagaggaaaaaagctcatgttagatttaaaaatcaggaaaaaaatttaacactaaacttgcaaatattatgtggtgtatattacagttacacatttactatgtaagtgcaactgtaaaactgaggaagtattccaaaatgttgacagtagttaatcctgaatgacagaacccaattgattttcattttcttccatttcctaaattgtcttcaatttccttgtactccttgaatatctgaattctagaacccccccccagcaacccaagcacaacaagaatattgggaggtgccccagctgcaaataaactcagacttggaatagtagcgcagttttattttctgtagtaacaaacatttaagaaccagataaaacatgaggccctcccaggaaagtagcaactgtgggaattcctgccctagggaaggatggacgcactgcctacaaggagacgcaaagtgggacctcgctccatttgcccaggccaggcttagcgggaaacggggggcccaaagcgctgcatggtccgcaccaccagggaaagctggtcaagaaagttgatgacggaaattcggagcaggcgacagtcttcagctttccagcggctaaaagtgaggggaaaagaaaatcaaattggaggtggcaactcctggtccctcgctctgcccctcaggcacccaatatagcaaacccttgggagccctgccattacacagcccctcaggcagagaccggcccagcgcacctggcgctccttagggctcatccttggatgtcccccatgtctccatgggccgcctcccccaaccccgtccctttcagaacttacacgaccaggatcctgccactcactgtgagatccttcccaaccaccctttggtggggctcggcatctggtgccagggacccatgggcgatttccgcctccaagggggtcgggaaaggcacgctgagggtgctgggggtcattcggttaaggtgccatctgatacgatcttgcctatgtctcaggccttcttgctcctctgaagccccctctcaggtcaccctgcctagtgtcacccccttcactccttacctcgcccaggccaccgttagcagagcttctccctccatttcaatgtcttcccctcctccgaccacctctgaccgtatacgccagccccggtccccccctgctaccctttccgtcggccccccgcccgccctcctttccttctccccgagtccagccctcgctccgccgcaagcagcccccagctcggaaaggatacaatatgtgcggccgcattcgtgaccccctggccgcagacgcggcgtctctgcccggacctggcgcgtgcgctgggggagctccaccggccggagctgcggctgtgtccacgcccccgcggcagctgtggccaccccggccatccccgccgtcagcgcctccgcctgcgtctgcatccgcgtcccgcatgaccgccgccgcgccgctccgactccacccccgaagcgcaggtcctacgccccgccctctctgtggctccttcccgaagccccgccccctgcgcacgactccgcccacacgcgcctgcgcaggtccctggagagcctgactggcgcgtggtcagttcccgccaagcggccctgccgggggccttctgagacccggtcagcggttgagaggctgcggtttcctccagaaactctgccctttcgcgcgtaactcgattccagagcgctggtgcaaactgacccacagtcggtccggccccaggaagccaaccctgacggggcttttgaagacaccgtggtcgcctatcccagaggcgcaccccgcgaggctccgcccctaagcgcgccttgtgaccttagcgcgcctgcgctggcggggccttcccccttgtccctggaggccccagtgaggccctgcggtgcctggacggcttcccgccccgtttcttacctggacccaagagccccaggagatgtggcacaacgtccatgttgcgattcgcagagggagggtggccgggtcgggtaacccccaaggatactgctcttgccctcaaccccagtgcccaaccaacggggcttcaccatggactgtgaagcatcggatgtgcattttagaggaagcattttagagcgggtgggctgtgcagagcgggggagcctgtcagcaggaggcctgcacggaggcgaaaaatgacagggccttgaatgaaagtactggcggtgggtctaggtctaatataacgtgaaaaatcagactgcacaactatgagtatgaaaatgccagtttaggccaggcaaagtggcccccgcttggaatcccagcactttggaaggccaagggaggaggatcacttgagcccaggagttcaagacaaacacaggcaacatagtgagaccccgtctctacaaaaaatacaaaaataaattttaaaagttagctgggagtggtggagcgtgcctgtagtcatagcttcttggaggctgaggagggttgattgcttgagcccgggagttcgacaccagcctgggcaacatagtgaaaccctgcctctacaaaaaatacaaaaattagctgggtgtgatggtgcacacctgtggtcccagctactagggaggctgagatgggaggacagcctgagcccgggaggcagaggctgcagttagccgtgatcgccccaccgcactccagcctggttgatagagccagaccccgcctcaaaaaataaaagaaaatgccaacttagtctcttactgtacatatgtagagaaatcctagaacaatacagcgtcaggtaaatcctcatgatctctgctaatagtatggtgggtgactttaatttcctttttgtgttttccctccaatttttccgaagtggtcttttatgacatttacaataaaaaaaaaaagtatttaaagtgacatcagtccgggcacggtggctcacgcctataatcccagtactttgggaggccgaggcgggtggatcacttgaagtcaggagttcaacaccatcctggccaacatggtgaaacccccggccctactaaaaataacaaaaattagctgcgtgtcgtggtgtgcgcctgtagtcccagctattcgggaggctgggacagaagaatcacttgaacccgggaggtggaggttgtggtgagccgacatcacgccactgcactccagcctgggcgacagagggagactgtctcaaaaagaaaaataataaaaataaaaaatgaataaataaagtgacataaaatttccaacagtgtttgtcatgtttggacaacctattttcctcctttgcagtcataaggaaggattaaacactgaactatatcagcaaatcctgttgggtttccctctgaaataggttccacatcagcccacttctcactctccactgctagtctgctgtggaagccagcatctttccttgacctccctcaacagcttcctggctgattctcttttacactttcccctctacaacctattcaccacaccgcagaatgactttttaatttctaatttaaattgcatggggctgggcgcagtggctcatgcctgtaatcccagcactttgggaggccaaggcaggcagatcacttgaggtcaggagttccagaccagcctgaccaacatggtgaaaccccatctctactaaaaatacaaaaattagccagttgtggtggcaggagcttgttatcccagctatttgggaggctgagacaggagaatggcttgaacccgggaggtggaggttgtggtgagcccagatcgcaccattgcactccagcctgggcaacaagagcaaaactctgtctcaaaaaaaaaaaaaaaaaaaattagccggctgtgacagtgtgtgcctgcggtcccagctaccagagaggctgacgcaggaggattgcttgagcccaggaagtcaaggctacagtgagctatgatctagccactgcactctgcacaagtaacagactgagactctgtctcaatcaaacaaacaaacaaaaaagtccatgatattcaggaaagaaagcagagataaaggaaaggtttttatagggaaatggcaagtaatagctgtagaaaaaactatcagaaaattaccatctttgcaaccaccaatgtaataattaattgttattaacttaataattgattcaggatggccaggtgcagtggctcacgcctgtaattccagcactttgggaggccgaggcgagtggattgtgaggtcaggagtttgagaccagcctggccaacacagtgaaatcccatctctactaaaagtacaaaaaaaattagccggctgtggtggcatgcatctgtagtctcagctactcaggaggctgaggcgggagaatctcttgaacccaggaggcagagattgcagtgagccgagaccacgccattgcactccagcctgggtgacagagtgaggctccgtctcacaaaaaaaaaaaaatcgattcaggcaaggaattgtcgctggatggcaaaagcattagctgaaaggttgttggggacaggatattcacaaagtccccaaatattaccccaaattacttgtgaatcaggaagggaaactgcgtctttacaggggagagatctggcagcagccacctggatcacgtgatcaaactgagcgtcctcaacagtggggcagcctgaccctgccagctgcctgatgaggggctgggggtgagtgtggtcagaggaggaaaggatacagtagcagcttccctggatgcttccaaaaatattcttgcctgattgcctatggagaatggctagttgggagaggcaaagatggcctcctgctccctcagaagcctggctgagtggcattgccagtcctccagccgggccgtggagaacacgtgtgtgctgaggagccggccagtgctggacgtgagtgccaagagggaagggactgtgtcttccagtctcagggttgccagcacctgggacacaagggggcactcagtgatgagcagggtgtcgtctgcagcaaagtcaggcgctgtctggaagacatgggcaggagctcaggagagagggccgggatgagacatagacatggcagtgaggcacagaaatagaaagcaagctggatgagctccccgaggagtgatacagagggaagagaaggggctcagggacagagccctggggcaccaacattgaggggtggggtgtgtgtgaagaaccagcaagagagcctgagtaggagcaagtggtggaaacagcgggagagcaaaggcagaagagggtgaggaatgaggactgccggccattcagtggggccctgaaggtgtatgcaggccgctccagctgggccctggaggaggacagggcagttgctgtgtgtctctcatctctcctgaaggcttttcagggctgggaggctcaaggctggccacctctgctgcatctactcctgggagtaccaggcccgggcagatctattggagctggtgaggctcacatgggacaccagctgatccattgccagggaacctccccaccccaaggcaaatgctgctgtcctctgaggccgctcttcctcccgtgggcccttgggaaacgacaccaaaagcacctcatcccagctgggcccttcactcatgctgctatctcctgatgtcattgtagtcacaccatggccgcaggactcagatactgtcccgaggcccctccctgaggggcaggtggtgggtctcagggcccttcaccgggcagggggcagtggatgactcggtgctacctctcagggcggacaattggctcagaggggcgcagcacctgcagtaaacattctgacccctgttaaaggatctcagcattgggggggctgcagcctgtggctgctccatcttcatgcagaatccccagtgtcctctaacgatccccccacttcctgtctcccatccctgcagtgtttcctctctctggtgctttccctaacccaagcctcagaaaacgctttccctgtgtgatcttgacgcctccagccctctcctccactacctgcgaggtggccctgatctgacacatgcatggcccctgtagtggacagctgccatttgcggccaccattgaggatatccattcatccagccctcccccagagccttctgtcccttgcatagcccatgtgtgtccagggaagtggccccatgcctagctccagggagccagccctgacggagaattaccccctaccccagccaaaatgattggacgcacaatccagttctgaccaacgagaagagtgtttatttgctgggggcatctgagacagcagaggtggtacacagagaagatgctgctctggcagtgagggagggattccgtggaagctgcaggcagccatcttttcatcctcggaggtggtggcctgggatgtagcagataccaacgcagagggaggcagaagacactgggtgaaattgctcacctgctgccaatgccaataccactggacttttcactttcataagccaagaaatttccgttaactgattaaacaaattgcctttattgttaaaccaatgattggatatcagaaacagcctagctaatatagctccttttggataaaagtagaagcctcacattcacctttaatgttatttcactttttccaaaatcaatttcctggcaccacacaaacaagaacactggtaaatgtatcacctgaactgcaggccacacatgctcacgagtgtgtccctgccgtaggtggctttgaagccatatacatggctctccagctctcgtggggggccaggggcttctgtgtgctcttcaaagccttcacccattgggcctctgtccatctttccagcctggggacccaatatttgccccacaaggcccaggcaggagggcctccagcacgcgcagccctgaccacactgtgagcagctcacttggcaagggtgaagggccggagtggcgtcctcctgatgtggcttccttccagcctctaccacccctgggggcctcctccaaggagcaggtggttagatgtcctcttgtgcccacacacacggcagggtggaggaggatgaaccggaacccagcccatgcttctgcccccaccctggcaccccaaggtttcttctcaggcaacaaggagcacacaaagtgagcccctgtacacaggtggctgggatatgttcatcttccacagggaggccagtgctggggatgaggacaaaggcctacgcccagtcccagctctgacactgccttgctgagtcacccatcagccctaacgcttcctggacgagacaagcagatagggtgccccagagaggagctgtgtcactaagggccaggacaccccatctctgggtcacgcttggccacggcttcatttttggcttcagtttgtttactgaacagaagggagaggggccctgtgagacagaggacactgactcaggtcggtgagtggccctcactgtatagagtccatggctggggaccaagtggcactgagactcgcccaaagtcacatcacagagctggggtgccttgctgactccctggccccaatctgcttttccatttgtcgaacgcacactggcacactggctgcagcagctgcgggggtcggggggttccagggctggctgtcactcggcctcctgcagaggtaagctgagggctatgttggacccgccagaagtcaggtgacagctgctttccctttcaggatcgggagggagtcacctgagggtatattctcagtgggctaaacatgacatgcgagagcccagctctccaagcggccccttcctccttctcacaccaaggcactttcagaagccgctggattccgactggggctgtgccacttcatcgccggtgcctctgctgtgccggctctcctcttctgagggtgtggaagcaaacccaggtcaagctgtgaggagtgcctagcacctggccagagccaggtacatgccagctatgacgatgatgagcccaactgcaacaggagaacacacttagtgcgacatgcagcggtagcctggcgttgggcacctccccatgctccgagaattctatttggagaagcccttctccattgtctcagtcacttcagggtgcaggaagcggctggccaaccgttcgatgtcgtccagcgtcaggcgactcagggacctctcgtaatcctggggagagaagggcaggaagattcaggggctgccagtggggggggggcatacactgcaacagaggtaggggctgggagcaactgggcctgaagaggatgcccagggttacccttctcaccctctgtagctgttccaggaccctgctggcatctgccgcactgaagtggcgggccaagactttggagatcagctgccagacctgcgggggtggggagtcggccagcctctgggcctcgccttcttctagtagcaccttctccaggggtttgaccactaggttgagcttggagttgggcccgatgctataatccgagagtcgtttcccatctgccaaagacagatcgatgggttcctcctcctccaccgccgtgggggtggcccggggcgcgaggccgcctcgggcggcgggagcggagcgctgcggcatccggctgtgaggcatgcggccgcctcccttggggtcatgtggcgcttggcgcccgcaccccgacccgacacacggctgctggcctcggcccgcgcaccccggtcccgcttcctgcggggctccccgggcgtctcctctccctgggtacctgccagggccttgcccttgaacagcagccgctgctggcgcactgggacgttcagcttctcggagaccagctgcttcagcgtggacaccagctcgtcctctggcacctggccgcgcggagggtgggaggcaagggttgagcccgcggcccccagacggcgaagcccacgcgtccgcccccgagggcagctctcccggctcccggccctcggcccggcctccccgtgcccgccctcggccctgccggtccccctgccaggagcgggcgagagagcgcgccggacccggcggcccggcccggggaccctacctgcaggctgcactcgcggccctgcagcgccttcaccgtcagctgcatggcggtcgcgacggcgtccactcgggccggcgcgcaccccaaccaccccccgccgcgcgccgccgccccgggcgcgcgctggaaccgcccgccgccgccggaagcagcgagaggggcgcgcccgccgcccgcgcttcccggccccgccctcctgccccgtccgcgccccggccccgccccccggcccaattgcgccccgggaggagtccccccggggtcccgcctagcacgcgcgcatcgaccgccctggccggcggacccctcccaaagcaacgacgcgggggagttgggagcaggaaccagtcgggccaggttggcgtcatctgggagctgggacatggagaagggagggccagaaggtacgctcgcccccgcggactgcctggcccaccccacgcgccaggactgctggcggcgcctggccctgcatacccacagacggcccgcccccgctccctgtctggtggcttcctacctcctcctttctggtctggctgcgaaacgctccactgagcttgagagggggcaggggggctacgcctctgccctcatcctcccacctctcccagagtggggacacccccggggagggctgatagggaaagcctatgcaggggtcaccgtgtcacccaagctggccctccaccctggtccacacttacccagcacactctttctacccccacgcccaggccccaaagggcaaagagtagaagggacccaagcttgcttctctcttttattgaaatatattttctgggcagcgcccacctacctaactcagcatggcctctttggcactgaaagctggagaataaaaaatcagtaaaaaaaataagcctggatttttctgagtgcatagtgcatgagaactttggtggagtgtgggggctggggctgatgaaagcttgacccagaggcctcagggaactgggaacaggctgctgtagatgaagtggccaatgaccaaggccagcatctcggaggtgccgctcagcgccacaatgaagggggcctgggaggcatagtcagcttgaaggcggcggagggatagctgcagcatggccaaggccagcaggctgttctgcacccctacctcaatgctgaccgtccgccgctgggccactggcagcttcagacacgtggctaggcagtagcccaccaacaggccaaccaggggcaccgtgatacccaccagtacgatgggtagccggatgcctgccaggatgaagacccccatgcgataggccaggaagaggccgcccaggaggagcacaaagctgaagggcttgacgacctgcagcagcagctgggagaacttggggagcttggacttgatcagcacgcccacggctatggggatggcaatgaacagcagggtccccaggatcttggagatgggcacgtggagcgtctcatggatgctgagcaggcggctgtagatggccgaagacagaggcaagaagccagtggcagccaccgtagagaggaaagtcatggagatggccagggtgacgtcccctccaagaaggaggctgaagaggtagctccccccgccgccaggcgacgagcaggtgatgatgaggcccagagccagggccttgggcagcatgaagaccttggccatgaggaaagcgtacaagggcatgaccagaaactggcccaggaggcccagcagcatgggctgggggctctgcatgagccccttcagaacctcgagttccactttgcacccaaacgaacacttgttgacaaagataagaggcaggagcaggtagaggattgggttttccgagaagtgggccaggtcggcgctgagggtggcaggcgtgtcttcagcaggtgagaccttgatgcagaagtctctccgctcctcaatcagtgtgggcggggcctcatgggcgtccacgagctggatgtggagtggggccagcccagccaggcctgagtggatgctcaccacaaagccacccccgcctccccaggttatagcactcacgttcttgatggtcagcacctctgtgtccagggaggtgaccctgagcatggggccaggcgccgtcctgttggcctggcctgggtactggctggagatcacgatgatgccctcactgtcctcaggaaactcaaactccatcacagagccatctccaatgctcaagtagcggcccccagtcggtggcacggtgtgacccccagcagtgctgaggctggtgctggctgtcccttgggccccccatggcaggctgatgagcagcagggcagctctgagcatgcttaagggacctgtgccaccaccctcgccccccagaccaggccactgctgagagctgcccttgtcctgcattaacaccatggctcttcctggaggacggatggcgtgcccaggccctctgcggcttaggagaacatccccactggtgctgttgggttgtcctgagaagggttcatgggtgggtcccagtcctgtgctgtcttccttgatggcagggctgtccctgaggaggtaagggacacagagaggcagctggtgagggtcacttaccctggaggccttggtccagccatgtgtcttacctctgaagagggaggcagtcaagaacccaggagcatggggatctggaagcccactgctaagagtaaaactcagcagggacccttgccccacactcaggaatggagaggcaatgcctagtgatggcccttgagtgccattcagctgtggctccctggcccactctacctgcccctacagtgactcgatgaaggtcctgctgggaagcaggtcctccctccccagggaagttgccagaaggggcggcaggagtggatcagacagagccacatgtctactgggggggtttctcctccttttgtcagagctcccactgggctgagactttgagctcccagagccactgcgttacatctgagaggctgtgctcagagtgcagggctccttcccatgcccacatgcgcccctaccagagcctcaaactcagtggaattatgagtgtttctagcggccagcaacacccccttccacttctcaatctgggcagcgaccaccgtagtgtcacatcacctgctagaactggggcaaccaggatggagacacaacagctttacatcacccctgtcagttgcctcatgcactgttgtgtcccagtcctagaagaggactgcctctatagatcctatccgtctttggcattggcctcccgtcatctgagactggggtgaggcagaagtagggagcagaggttaggttaagccaaaggctcatcccggcgagcctcccctatccctagcttaggatgacatggcctctgctggcttgaagttcgggtcacttaccctggaggccttggtccagccatgtgtcttacctctgaagagggaggcaggaaaaccagtggggtgggagaggcaaagtacaggagctaagatgaaggcaccaggactgaagccaccggggtgatacaaaccagctcagaagggaaaggctaggggccatccaccccatgccccatccctccagtagggctggcggctctgagtcactccaagaggggtttggcccagatcccacaccatttctgcttgaggggccgacagagtttgagcagatgcacccacaaggcaggggagggagtcccggcccttccaaaacggccaagtgttcggggtaactggcagtgctaacaggggctcctccctacctgggagtccggaagttgtcggacgggtggctagcagagctcgggcgcgaacctgggagggaggaaaggaagggcacgccgccgtcccacagccggcgacccgctcgggccgtctcggagtctgggggggccccttacgccattcctgggccccgcggccccgccaggcctcgcaaacgcgcggcggcggcggcggcccttccctgccaggcccggccgggcgcccgagtgggcgatcgcggagcagggtcggggccagaggccgcctcccttccggaggctctcacctgccacagccaccgcgcagcttagctgcagcgtctgcctggcaggcagtcgcccgcgagctcggcctgtcagggccccgccccaccgaagcccctcccttccccgccccgcgcgtcagggccccgcccccccctcagcgtccagctcaactccggctgctcgctgggctccgaccggttgtgacgtctctgggagtgacgcgccggcgcgggcgcggtgcgggtgagctggtcggcgcttggcgctgcctggaccaatcgcttggcagcgcatctgaagctgttgtgatcgctggggcgacccgctctgggagggagccccaggcattcccgattacgctgcgacctctaaaggcaatgggacagagggttagacgttagcagggctgggtgcccggggttagggttttggccacgttgccgctcaaggtgcccagccctggggccccagggttgagtttgaccgacctggacgccaggctctgtgcggagttcctcctttcgttcaagtattgaccgagcgcctatttctattttatgtatttattttctgagactgagtcttgctctgtcacccagcccggagtgcagtggcgcgatctcggctcactgcaacctccgcctccctgcaacctccgcctcccgggttcaatccattctcctctctaagcctcccgcgtagctaagattacaggcgtccgcccccgcgcccggctaatttttgtatttttagtagagacggggtttcaccatgttggccaggtaggtctcgaactcctgacctcgtgagccacccgcctcggcctcgcaaagttctgggattacaggcgtgagccactgcgcccggcgtaggccagtttctatactgtggaacattaagtggacttgtctgcttttccaaactttggcgccactagcaaggtgcagaggctttgtggtaaaggaagagaaagaaggcagaaagttggggaaaaatatgatgggaatgtgtagaaagaaggtcggaaggcagtacagaagacagtacagagttgggggggggggatcatatgttcccaaagcttattggtgcaactggaatcaatctgcacacttcaacctcttgtcaagactgtgatggagtcggaggtatttgccccgggtaggtgcacaagacgcatggttgcagatgtggaaacagaacagaacaaaaccacccacgtctctaatgtttcaaatgaatgatatacatttgtttttattacttatttatttatttttgagacagggtctcgctctgtcgcctaggctggagtgcagtggcacaagctcggctgactgcaacctccgcctcccggattcaagcgattctcctgcctcagcctcctgagtagctgggattacaggcgtgcgccactaccacccggctaatttttatattttttagtagagacagggtttgccatgttggccaggctggtctcaaattcgtgacctcaaacgatccacccgcctcagcctccctaagtgctgggattacaggtgtgagccaccgtgcccagccaaataatatacttttaataaatttattgacatttaaatttattttaaaactttatttatttatttagagacagggtctcgctctgttacccaggctggaatgcagtagtgccatcataatcactgcagcctcgaacccctgggctcaagcgatcttcccacctcagtatcccaagtagctgggactacaggagcatgccaccatgcccagcttaaaaagtttttttggccgggtgcggtggctaatgcctgtaatcctagcactttgggaggccgaggcgggcggatcacgaggtcaggagattgagaccatcctggctaacacggtgagaccccgtctctactaaaaatacaaacaaattagccgggcgtggtggtgggcgcctgtagtcccagctatttgggaggctgaggcaggacaatctcttgaaccccgggtggggggaggttgcagtgagccgagatcgcgccactctcctccagcctgggcaacagagtgagactcccatctcaaaaaaaaaaaaattgatttttgtgtgtgttttacaaagttcaagttagtatgtgcgtataatatgagcaaatatacatatgctgagggttgttacaagggtttgatgtgtggatgatcaaaaacatttgcagccatagctctcagccattgtttagcctccagggatcactaaggcagaagcgatttgtgtgtttgtacttggtgttctggaaaggttgttctgtccctttcaaatggggttgaagggtcctgatggaagtagacagtatttagactaggacaggtgaaagggctggactaggcacatgctggggctgaagattgcaatttggaaaacggcagtgagggtagggattgtctgaggatggggtaaaattggccagagggagaaaggagtcagctggaaaagccaaagaaggaaaacccaaaaagttgtgtccttcttgaaggaaaagggaatttttgtattccacttgcctgtgctgttgggcctgcctgacactgtcagtaaaattcacctggaactagccacttggcagccaccaattcttgtttttgccaggtgtcaaggagagcaaatgcagtcagaagactgctgtctgttattgtcaatcacttcagccttccctgaaaagcccaagtgggcaggtgggatatctgacatgaagaatttggtggctttgtctgcaggaaaagggaatagcaaaattaaaggcaagacaatgttcctagttggtttagggaatcagtaatttaccccagggtgcgggtggctcacgcctgttatctcagcactttgggagaccgaggcgggtggatcacttgagctcaggagttcaagaccagcctgggcaacatggcaaaaccccatctctacaaaaaatacaaaaattagcctggcgtggtggcatgcgcctgtactcccagctactcggaaggctgacgtgggagggtcgcttgaaccccgggagatggaggctgcagtgagctgagatggcaccactgcactccagcctgggcaacaaagtgagaccttgactcaaaataataataataataatagtaataataataataatttaccctagaagagaaggaggaagaggtgaggatatctagtgcccaaagagaagtcatctggaccgaacaaacagatggaacaaatgatagcaacagctgaaacaacatcaacacatttcagatgggaggcctgccaggtattatgtaataaggtcacagtggtgaccctgagaggcatgcctacctctgctcttgaggcaggggcctctagaaacaggattttttttttttttttttttttttttgagacagagtctcactctatcgcccgggctggagtgcagtggcacagtcttggctcactgcaacctctgcctcccgggttcaagtgattctcctacctcagcctcccaagtagctgggattacaggtatgtaccaccacacccagctaagttttgtatttttagtagaggtggggtttcaccatgttggccaggctggtctcaaactcctgacctcaggtgatccacccacctcgacctcccaaagtgctgggattacaggcataagccaccgtgcctggcccagaaacagtatttgataaataaagaggccaggtgaggtggctcatacctgtaatcccagcattttgggaggctgaggagggaagattgcttgagcccaggagtttgagaccagcccgggcatcatgggaagaccctatttctacataaacagatttttaaaaaaatttaaaaaggcatggaaggcatatgctagtgtaagtatgaggtacattgagtatccacagggaagtgtaatgacacctgtcacttttgcctgcccagcatcaggttgcagcaccttagttttctctgggggaaccatccctcctccactctcagtacacatggtttgcatgtggatgaccccaacgctgggccctggagtgggcacataaccaggtataaccagccagccactcagagtgggcagacatcatgccataatccagtctggaccagtgagggttagtccccaggaacttgtactgaagtattgggaatgccatcctaagtcacagagagggagactaaaagaaaatggtatttatttggaatgggtactgcaatgggaatgtgtgtgccatagtaaactgtgtatattcagggaggcgaagggagaaaaagggttttgttgttgttgttttttaaggtagggtctcactctgttgcccagggtggagtgcagtggtgtgatactggctaactgcagccttcacctcctggactcgggtgacccttccacttcagccccctcgagtagctgggactacaggcatgtgccaccatgcctggctaatttttttgcattttttgtagagatggggtttaaccatgttgccttacactggtcccaaactcctgggcttaagcaattctcctgtctcggccttccaaagtgctgggattacaaacatgagccattgcagcaggctgacaaaggtgttttttgtttgtttgtttgtttgtttgtttgtctgtttgtttgtttttgagatggagtttggctcttgttgcccaggctggagtgcaatggcgcgatctcagctcactgcaccctccgcctcctggattcaggcgattctcctgcctcagcctcctgagtagctgggattacgggcacccgccaccacgcccggctgattttgtatttttagtagagacggggtttcactatgttggtcagactggtcttgaactcccgacctcaggtgatccgccttcctcagcctcccaaagtgctgggattacaggtgtgaaccactgtgcccggctgagaaaagtttttaaagaaaaaatgagaattacataattgttttcaggtaattattcttggctacaaggattaataacaaaggtggcatcagtccaaatttggacaggcagctgctgggtagatgtgttcacagaagtattttctgtgtgtaaggtgatgagactgcaaaaactatatcactctggtgatgatagccgttgtacagggttatagtttttgcagtctcatgatgggttttgctatcaggcatcacacatgagaaccttcccttcatggccttccccagctccggttttcgggttttttttttttttttaaggtggggtcttgctatgtgaccctggctggaagtgcagtggcttttcacggagcgatcctactactgatcagcatgggagtttttatttgctctgtttctgagctgggctggttcactcttccttaggaaacctggtggtctcctgctcccaggagattaccatattgatgctgagtttagtggagacaccagatcagaatagcataccacagcccagaaatcctgggctcaagtggtcctcctgcctcagcctccccagtagctaggaatacaggtgtgtactaccatgcctggctaatttttaaaaatttttcgtagagacagggtctccctatgttgctcaggctcatctcgaactcctaggctcaagggatcctcccatgacagcctcccaaagtgctagactacaggggtgagccaccgcacctggcctagcatggaagttttaacctgctccatttccagcctgggctggttcattcctccctagacaacctagtggtcctccattcccaggatactgatgctgagctttttgtggacacctgatcggcctggcatactacagcccagaactcctgggctcaaacaattctcctgctgcagcctcctgagtagctaggactacaggcatgtgccaccacacctggcagggtttgtttgttttttttttttttttaatgagacagagtctcactttgtcacccaggctggagtgcagtggtgcgatcttggctcactgcaacctccgtctcccaggttccagcaattctcccacctcaacctcctgagtagctgggactacaggcctgcatcaccatgcctggctaatttttgtatttttactagagacagggttttaccatgttggccaggatggtctcaaactcctgacctcaagtgatccacccacctcagcctcccaaagtgctgggattacaggcgtgagccactgcacctgttttgtttttaatacaggtgactccattttgcttctggcaactttcacatttcccctttttgatcgtgatctttcttcaaaagcagtaggtttggattgtccctcagtgctgggatggacctgtcctgggttgttggtctggttccagataagagggagtgattgacaactaagagtcagtgtcaaaacccctttaggcacatctgagcaacagtggaaatttggagagagttgcactcagactaagtctacctgaagtccatcgttaaattctattttttctgttctgtggtcttttggccatcatctggaagccccgtgccagcatactctgttagcagctgtacttctgcagaagtttcacaagtaacaagtacaaattgttaaaaggaaaatacaaattaatattagtagtaatatgataccaccagttttcataatagttttgagctatgaacctaggcttaaaggcaatcaagtgaataaatcaaatgaccatggggaattaggtgagacccattataacctatgtgacctgttataacctatgttttgtaatttcgtgtatatggggcctcaagttccccaggggaatttatccaggttcagcatgtgctattagcaatagaacagatatttcctgatttaaccaatagatgctgaaggatctcttaggtcaggttctgtgaggttactgacagaagctattgattgtgcaatttcaattacaccattatcctgtcaacgaaaaggcagacataagaaaggaaaaattaagagtgacaagattttcattttgatgggtgaagctctcaacttcttttttttttgagatggagtctcgctctgtcgcccaggctggagtgcagcagcatgatcttggcttactgcaacctccaactcccaggttcaagcaattctcctgcctcagcctcccgagtagctgggattacaggtgcgtgccaccacagccagctaatttttaaaaaatatttttggtagagatggggtttcaccatgttggccagactggtcttgaactcctgaccccaagtgatccgcccgcctcggcctcccaaagtgctgggatgacaggcctgaagccaccgcgcccagctgaagcgctcaacttcttgttctggtttgcagtttgagtgtctctggttatggcatcaggtggtttggagaacttcctgtgtgacccatacatcaggcatgagacttgtccctggatatttataccaagttttccagcttcagcttcaaggcctttagcaacataacaggtttttttcttagttggagagttttagccaaatattagaggaaattaggaggatttggggtctagtcccgtcttcatgtagataagaaacaatgcaaagggctgcaatctaatagcaggcatattttagtgtttttcctttagaaacaactttttctgggaggccaagacgggcggatcacgaggtcaggagatcgagaccatcctggctaacacggtgaaaccccgtctctactaaaaatacaaaaaaaaaaaaaaaaaaaaaaaatagccaggcgtggtggcacgcacctgtagtcccagctacagattttttttgagacagagtctcgctctgttgcccaggctggagtgcagtggtgcaatctcagctcactgcaacccccacctcccaggttgaagcaattctcatgcttccacctcccaagtagctgggattacaagcatgagccactgtttttgagacagggtctcactctgttgcccaggctggagtgcagtggtgccatcatggctcactacagtctcaacctcctgggctcaagcaatcctctcctcctacctgagctccctgagtagctgggcatacaggtgcgcactaccacactggctattttttttttttttttgtagagatgggggtctccttatgttgcccaggctagtttttttttttttttttttaacttttgtaccttttgtatttttagtagagactaatttttgtatttttagtagagatggggtttcaccatgttgggcaggctggtctcaaactcctgacctcgtgatccgcccgccttggcctcccaaagtgctgggattacaggcgtgaagcaccgcgccccgcctgcccaggctagttttagaactcctgggcttaagtcatcacctgtctcagccttctaaagtgctgagattacaggcgtgactcaccatgcccacctaattactatatttttgataaaataattaatgcttttaatttttccctttaattaattagatatttttcatatattttggtagaaaatattacacagaatgtgaaaacgtacggacacatgattacatagaaacagattccctagctttcattttgaaatttttgtcatgagacagtacaatatagtaatatacgcttgccagtttataaaaggacagttggatccaatttctgacaaaatgagacccgttcgtgtggctgagcattatttgaccccataggtaatcttatgaaggctgaagatcaaaattttgggtaaagcagcgtctacagcagtttgatttaaaatatctttttaaaatccttttattccatatcaaatgagtttagaggttaaatattcaaatgttcacatttcagttaggactagctgaattgtatgagaaaaacagaatttccagtggccaatctggtttgcttgattagtcagcacaggtggagaggcacttttcaaaaagatatttacagttgttttttttcctcagctttttctggattgtacatgacagacaaagccaaatttttatgctggacagagataccttatgtgattgctgtgtgctcaagagtttgacctgtttgatctgagaacctaactttcacaaacattgatctagttctttcctttttagactatcaatcttttaattaactgttccgtcaccctaagcaattgtcagctaggcaaacctccatacatgtttctgaaaggaatgactcctaagtgtacaaggctaggtttttggttgccatggagctgttgtaatttgaaagcacccttttttcttttctttttcttggctgaaatgccctaaggaaaagttataaacagcttttgaaatcaccaatgttagattatctttttttattcttatttttttgagacaagatctcactccatcgcccaggctagagtgcagtagtgtgtcacggctcaacgcagccttgaacttccaggctcaagtgatcctcccacctcagcctcctgaatagctgggaccacaggtgtgtgcctccacgctagctacctttttgtatttttaatgtagggttggggtctgatcaggttgcccagggtgaaattatcttaatacaattatcttaatacaagtgaagaagctggctgggcacggtggccacgcctgtaattctagcactttgagaggccaagatgagtggatcatgtgagctcaggagatagagaccagcctgaacaacatgatgaaaccccatctctacaaaaattagccaggcgtggtggcaggtgcctgtgttcccaactccttgggaggctgaggtgggaggatcgcttgagcccaggaggttgaggctgcagtgagctgagactgcaccactgcactccagcctgggtggcagagtgagaccctgtctcaaaaaaaaaaaaaaaaaaaaagaagaaaaaggccaggtgcggtggttcacacctgtaatcccagcactttgggaggccgaggcaggcagatcatgaggtcaggagatcgagaccatcctggccaacatgataaaatacaaaaaattagccaggcatggtggcgcatgcctgtagtcccagctactcgggacgctaaggcagtggaattccttgaacccgggaggcagaggttgccgagatcgtgccagcctggtgacagagcaagactccgcctcaaaaaaaaaaaaaaagaagaagaagaagaaaaagccaacagagtcagcagagaggaggaagaaaagaaaagcagatagagaagttaggcgcctctacataccagtgttttagttttatttatttaattttattttttattttaattttatttttttgaaacagggtctcactctgtttcccaggctggccttgaattcctgggctcaaataatcctcctgtcttggcctccaaaagtgctgggataacaggcatgagccaccgtgcccagccccaattccttttaaaggtgattttgtttcgggtctcacttattttttttttcttttcttttcttttttctttctttctttcttttttttttttctgagatagccttgacccctgggctcaagccatcctcccacctcagcctccctagtagctgggactacaggtgtgcaccaccacacctggctaattaattttttttttttttttttagagacagggtcttgctgtgttgcccaggatggtgtcaaattcctgggctcaagtgatcctcctgccttggactctcaagtgctgggatgacaggtgtgagccaccacgcccagctgtaggtcccacttctgactctagttatgtcatcctaaataacaggctctctgagagaaaatgatatttattctggaatgcgttgcagtgggaatgcatgtgccatggtaaactgtatggtaaactgtgtgcatatacagggaggcaaaagaaggcaaaggtttttcaaggaaaagtgaagaggatcacctaattgttttgagagaattctccttggctacaaggatcgataacaagggtgacctcagtatgaggttggacagggttagggttaagttgctcagctgggtgcggtggctcacgcctataatcctagcactttgggaggctgaggcgggtggatcacctgaggtcaggagttcaagagcagcctggccaacaaggtaaaaccctgtctctactaaaaacacaaaaatgagccaggcgtggtagcgcatgcctgtgatcccagctactcaggaggctgaggcaggagaatcgcttgaacctaggaggcggaggttgtggtgagccaagattgtgccactatactccagcctgggtgactgatccagactccgtttcagaaaaaaaaaaaaaaaaaagtcagccgggcacggtagctcacgcctttaatcccagcactttgggaggctgaggcaggtggatcacttgaagtcaggagttcaagaccagcctggccaacatggtgaaaccgtgtctctactaaaaatacaaaaattagctgggtgtggtggtgcacacctgcaatcccagctacttgggaggctgaggcagaattgcttgaacccaggaggcggaggttgcagtgagccgagattgcgccactgcgcttcagcctgggtaacaagagcgaaactccgtctcaaaaagttgctgggcagatgtccttgcagtattttttttctgtggaaagctgtggtttctgcatttgcagccttccccagctctgttttttgttttttaacacaagtgactccattttgattctgacaactgtcatggcaaggaaggctgccatgttggaaaatgaagccaatacagagagaaaaacaaagccaagaggtggagagagcccaagtcccttgggcttcggggtccattacaggaacaatgcattctgccatcctcccttttttttttttttttttttttgcttatgccagtttgagtttgaattctggcattgtaagtgaggacatcctaactcctaaagggcaggcccagggggcgatacccctggcaaaacaggaccgtgggatatgtcaagcttacctcctctttgggaagtcaggcaggctgtgctccatgccatcagcttcctagcctgtgttgggctgtgacactggtgaccccagtgagggtgcagccccatgaagaggtagaggctgtcactgtggctcactacggtgttcctggaccagttcaggcacttggtgaatgtttagtgaacaaatgagctgaaggaacaaatggaggaaggctgggcaatcacagcagttgctggagaagtgtcggggagcccaagcccctcccagcctggcagtatagacactccgtgagtttccgtttcatttaggggcaagctagtaacctcgtggaattgtacttatctggcttgtagtcttgctacaccgggaactctcctatccccactagggacctttacttttttgtacagtggggacaatggccacacttactggctagggttgtggtgaggtgttacctatggtataactgaggtattgatgcaagaaggaagttgagatttgtatcaacatatgggaccatgtgggtacagatgagacagcactggtcacatgtcgatcactagagggatgagcacatcagagttgatgacagtcatctgttggtatccgataggtatttgttccagggcaccctatagctgccaaagtccagggatgctcaagtccctgatataaaatggatacattatagttatacatatttattcccatagatttttttttcttttgagatggagtctcgctctgtcacccaggctggagggcagtggtgcaatctcagctcactgtaagctccgcctcccgggttcaagcgattctcctgcttcagcctcccgagtaactgggactacaggcacccgccaccatgctcagctaatttttcgtatttttagtagagacggggtttcaccgtgttagccaggatggtcttgatctcctgacctcttgatctcctgaccttgtgatccgcccacctcggcctctcaaagtgctgggattacaggcgtgagccactgtgcgcccagcccttttttctttttttttgagacagtgtgtcactctgtcgtccaggctggagtgcagtggcgtgatctcggctcactgcaacctccacctcccaggttcaagtgattctgcctcagcctcccgagtagctgggatcacaggcatgcgccagcacgcctggctaatttttgtgtttttagtagagacagggttttaccatgttggctaggctggtctgaaactcccgacttcagattatctgcccacctcggtctcccaaagtgctgggattacaggtgtgagccaccgtgcgcggcctgatttttttttttttttttttttgagacaaagtctcgctctgtcaccctggctggagtgcagtggcacaatcacggctcactgcagcctcaacctcctggactgcagcaatctgcctgcttcaacctctgtaagtgctgggattacagacatgagccaccaagcctggtcccatagaatctaaaccatcttgagattatttatcatgcttaatacaatgtaaatgctctgcaaataacaattacactgtattgtgtgtgtgtttttttttgataggatctcactctgttgcccaggctgaagtgcagtggtgtgatcttggctcactgcatccttgacctcctgggctcaagtaatcctgtctcagtctctcaagtagctgggactacagatgtgtgtcaccacgactggctaattttatttttttgtagagatggggtctcgctattttgcctaggctggtcttgaatgcttgggctcaagtgatctgcccactttggcctcccgaaggctgggttatagggcatgagccaccatgccagcctacactgtatttttttttttttttttaagacgaagttttgcttttgttgcccaggctggagtgcaatggcacaatcttggctcactgcaacttctgcctcctgagttcaagtgattctcctgcctcggcctcccaagtagctgggattataggcgcccgccaccacgcctggctaatttttttttttttgagacgggagtcacgctctgtcacccaggctggagtgcagtcatgtgatctcagctcactgcaagctccgcctcccgggttcacgccattctcctgcctcagcctcccgagtagctgggactacaggcgcccgccaccacgcccggctaattttttgtatttcttagtagagacgaggtttcaccatgttagccaggatggtctcgatctcctgacctcgtgatccacctgccttggcctcccaaagtgctgggattataggcgtgagccaccacgcccggccactgtattgttttttacttgtactattttttattcttgtatttttattttttccaagtatttccaatctgtggttggttgaatctgtggacatggaacccccatggatatgaagggccgattgtatgctagtctgtctcctggagatgtttgcaattttccatagcaagtctaaagagtgaagtgtgtatgatcctgcagtggatccatcattacacatttttgtccaaacccactgaacgtccaacagcaaactgaagcctcatgtgagcaccgatactggttcattgacagcaacagatgggaagctgggggctggcagggggcacacaggaactctgaccttttcactcagttttgctgtgaacctaaaatggctctaagaaggaaagtttacaaaaacaaaaaaggaatggaatacacgtagaaagttcctggtgcagaggcaggactggcatcaccatcgtttcctccctggtgagccgctcctccagggcacccctgtgcctccaaccccacatgtgcctgctccagaagcacttttgtcttctgaggctctgtctgcgctctgtactcttcctgggattggctcctaagtccatcgcccctaacgtcgccccatgaaggacaccacagtgcctcccatctaggaactgccttctctcctttcgctgaactcagactgcttctgggcctctggagttgatattccagcaaaattgcttctaatttgctggctctcgcttagcaaagggaggtattaaccgtaacctgggagagacgcaaaaagcccaagtgactcgacccctcacaaccctgacttcaaaggcagccgaagtctgtgggcgacatgtgctcctggatgatgatggggtgtggtgggggcctgggctggtgttaatcccaatccctgtccctgtccgtacaggcctgcactgggtcagagggagttgttgagtcagcttcctgcagcccgagtgtgcaatcttctctgccagacgaaaagagtcccactgctctgttgactgcttgagtcacatctcagtcgcagcggggcctgttggtggcaggagccctggagacaaaaggctgtctgctcgggctgtgggagcaggttggttaagactctggaatctgtcctcccgcaccccagaggacaccgccacctctgactccgcactgacaacagcatctgaaggcatttcttctgtggggccatcactttattaaggggtcatctagaaggtgggccccctgacaaaccgcgggactgtgatcgggctccagctacttcaccaccccgggccagcctgctccaggggtcccttcctgctgagagcaggcgagaggcagtcaggctcatgaagcagccaccgggtttggctcactggaaggaatcacactggaaacatgtttagcccgcagtgcagagtggctccagaagggagaggttctggaagacgccccaacctgccgggctgctcccagagttgcacagtgaggggcaggcacccagggccgttccaggactcaagatggggatggagatggcgtgaggaatggaggacagggctagatgggctgaccggggggaacagtgttacgaaaaggaggcgggtaccctgggctcccgtgacaaagtgcggcagggctaccccctgcagcccccatagcccccaccaccttgagaccacgttctggtcactgcctcggagccccgatgtgttggggccagggagcgctcctgcccgggtgtggggtgtgagcctcagcctctgtccgcccggcagcgcgcgtgcctcccttggtctggcctccctcggcccggtcctggcactggccgtgctagctggccgtgcttctccgcgggatacagccttccatctccagcgcctcgggccagccttcgtacttgttgctgtgcttactgttcttcacgtgctgtggggaggggagcagaaagtcatgactttggccctcagggacaggggacaggagtggaccaggacccaggctgtcagtcaactgtgctgtgttggccaacggtgtactctcagggcacttggcccctccacccatcccagggaaacatggcatcagctgcactggcccacccctcatagctggactggggacggtcccctgctggggcgtgagcagctggggaggctcgtcgcatgcaggcagaaggggcgacaggctgccccggtgggggtgatgccaggcaccccccatacctgctcaaaggggctcttgttctgcacacccttggccccgacaaacacccagctgtcccggaaggccagctccttggcgttcctgctgcccagctcactgaagagctttctggtctcttcattcatcctgcagcatgggaggaaggggtgtcagctgttgctgcagaagggcaaggctgaggctggcctccccaagcacctacttggtggctgggtcgtcgtaggatgccacgaacaccagggtgccttcgtgcagtggccgaataaacttcaacaggtcgttgacatctgggggggcaggtgccacggaacaggggtcatcaggcaccactgagcaccctcccacaagcccgttctccaaacaaggaaacagaagtagggattgggcctgggacatgccccgccaagggacaggctggtgtaggaagctgaggcatccccgtgacctcccacagcctccagaccaagctggcgatgcccctgtcctttctgaacccacggaggtgactgagaagctccaagtacagacagagagagcagtgtctcaggggaagctgcccaggtcattttgctgcagtcaaaatgcaagacgctgcgctgcaactcacctccggcccacatgtcaaaggcccgggcctcgatgagctcgccgctgacccctgtgtcaggagggaggggccctgctgggtaagccaggccagcctcagggcacggcaggcgggtagcaccgggggtggggggcagcccttctggaagctttcaaacagtcccccaatattcatccatttgttcaggcagctgcatcccaccccaagccgtggtgcctctgtctggcatttgaggccctccgggggctctccatgaagcaccctcaacctcccagaaccttccctagttctttattgccatcatgcttttttgttcattgggtcactcctctgtggagccttgcgcttgcacagactccttcccaggcctccctgggagatcttgaatgggaggggaagggagggcaaacacccagaggcctcctggggagggagcagggaaggagggcggcaggccacgctcagccaggggcctcaccgttcaccagggcgatgttcagcccgcggcccacgttgtccttgacgctgctcatcagcctagttgggggggggtgggggggacggggagatcccacatgggcacgtctgctccactctcccttgcagacccggccctggatcccccactccctccctgatccccagtcaccccagggagctcacatcttgtcctcgaggcagatcttgggcccaatgacgttggcggccccgctgaccacgcggaaggccaggtgctcctcaggacacggctggggcaggccacacttgtacttcctggcccgtggcgctgggcagggatagcaggtgttatccatgggcctggccctgaggtcacctgagatctgaaggggaggtcaggaccagcacacatggtagaacaagtgaccgcagagcaggacacaagtagggggatgtggctcaggccgaggctggggacacttccatactctgtgtcctactggtgaggccacagggacccaagacagaaggattttctgttactggtgggagaaaagaaaggatgctgagggctggcctgggccactgcacagccaggaacaaagcaggggtgaagtaagtcaggctgggggtctagctgcatggatgaggccaacctgagcaaaggcagtgtggcagggggtagtgtggcagggggtgcagcctgtctcccgattttgatgggggttggttgggaggactggagcaggatggcttctattatgggttgaattctgtcccctcaaggtatgctgaagttctaatctgtggtacttcagaatgtgatgtttgcaaatagggcctttgcagttcagatggggtcatactggagtaggttgggtccttaatgcaacatgactgatgtccttataagaacagaagtgacaaagacacacagagggaagacagccatggtacagtggaggaagagacaggagtgacacagccagaggccaaggtatgcctggggccactggaacctggggaggtcaggaaggaccctcctgtagaactttcagggtgagtaacgccctgctgacactttgatttcagacttctggctttcagaatggggagagaatccatttctgttgtttaagccacccagttgaaatggcagttccaggaaatggatacaggttttggcaccaggaagtgtggtgcttaggtaacaaatacctaaaaatgtggaaatggctttggaactgggtagtcagtagaggcttgtcttagtccatttgctgctgccataacagaataccacagactgggtaatttataaagacaacagattcatttggctcatggttctggaggctgggaagtccaaaagcatggcgccggcatctggtgagggtcatcccgtggcagaaaggtggaaggtggaagcaagcatatgagacgcaggaaaaaagggggctgaacttcaaggtaactaactcacccataataatggcattcatccattcatgagggcagagccctcatgacgtaactacctcaaaaaggccctcctctcaataccaatacattgacaaatttcaacatgagttttagagatgacatttaaaccatatcaaggctatagaagtttgaggtacatgttagaaaaggtctggattgcctttaagagactgttggtaggagtatggatgttaaaggtaattctggtgagaggaggggagagcaatagagacagcctctgtggtcttagagaatacaaatatcatcaagaacagaacgttgctagaaacatgaatgttaaaggtgcttttgggttgggtgtggtgattcacgcatgtgatcccagcaccttgggaggccaaggcaggagcatcacttgaggccaggtgatcaagaccagcctgggcaacatagtgagaccccgtctctacaaaaaatacaaaataagctgggtgtggtggtacatgcctgtaatcccagctactcaggaggctgaggcaggagaatcacttgagctatgattgcgccactgccctccagcctgggtgagagagcaagaccctgtctcaatacattcaaaaaataaataataaaaaataaaacattagctgggtgtggtggcacatgcctgtagtcgcagctacttgggagactgaggtgagaggatcgcttgagcccaggagtttgagcttacagtgcacggggatgataccactgaactccagcctgagcaacagagtaagacctctgtctctaccaaaaaaaaaaaaaaaaaaaaaaaaggtgcttttggttaagcctcagaggaaaatgagggacatgttattgagttattgggcgctggaggaaagctgatccttgttataaaggaacttggcccaggtgtggtggctcacgcctataatcccagcactttgcggggccaaggcgggaggatcacttgaggtcaggaattcgagaccagcctgaccaacacggtgaaaccccatctctactaaatatgaaaattagttgggtatggtggcaggtgcctgtaatcccagctaatcaggaggctgaggtgggagaatcgcttgaacccgggaggcggaggttgcagtgagccaagatggctccactgcactccagcctgggtgacagagcaagactccgtctcaaaaaaaaaaaaaaacttggttgaattgtgttctagtgttttgtcgaaaggagaatgtgtaagtgctgggtgctgaacttggatattcagctgaggagatttccaagcagtgttgagagcgtagcctgacttctccttgctgcttatagtaaaatgtgagagacataaggaagaaactgttgagcacaaaggagccagaaagcgaagatgtggaaaattcttggcctaatcatattacaaaaactgcaaaagtgtcccctggacagaacagcaaggctgttcaagcgtttgccccagagctgaggtatgtgactcgtgggtccactcaaccctttcagcagaaatctacaatgaagatggggttatctaggaagcgtctgtgggaaaactctctgattttatagcttgggcctctataacttgcaaaagagaccaacaaggctcttgagaatctgacaccagcagaaacactgccggcctggagtgaagggggcagagatgagataaagggaaggaagggtggccccgaaggtggggctgtctcgtttcagagcatgggtcattccagcaggcccagaagaaagaatctcaggccacagaggattcccctcaggccttgaaaccaaatgaattttgccctgctgggctttggacttgcttgggacgggtgacctcttttttccttccaagttgcccttttgcagtgggagtatctatcctaggcctgccccaccgtcatattctggcaggaagtaacttggcaggaagtaacttgttttgtaggttgacagtggcaagcagcccccgtggaccaccacagctggtttggggaggaataaatggaaaaccgaagccctacgggaccgggggcaggcagggatgtcacaaaggggaggagcagggaggtgacaggggccttacctgcagtcaccgagctctctggacctgtggatacagagtggtttctgttagtgtggagcctcccggggcctgcggcagggcagcctggccctccttacaccgcgaagtgtagacacaggcagtcaggctcaggggccgggggctaagccaggccgaccttggcatgcttcctgctcaagtgtaagtcatgttcagatgaaaaactccctactctaggaacagggggaaatggaattagaaaaactacttagatgacctggccgggcatagtggctcatgcctgtagcactttgggaggctgaggcgggtagattgcttgagcccaggagtttgagaccagcctgggcaacatggtgaaaccccatctctactaaaaatacaataataataataataagaagaagaagaagaagaagaagaagaagaagaagaagaagccgggtttggtggtgcgcacctgtagtctcagctactcgggaggctggggcactagaatcgcttgaacccaggaggtagaggttgcagtgaaccgagattgcaccactgcactccagcctgggagacaaagtgagacactgtctcaaacaaacaaacaaaaaagtactcaggtgacctattaccagtcaacaaggtggagagtcccctctccatctcagagcctgcagggagcaaccggggcatcactccccatgttcagtggaagctccctaccccttactctggccctactgactccagttgggcatataattctagtgatcaggtattggctttcctagatgaagcaactgggtgttgggggaggctgcgcctgatgccaggagacagactggggacagccaaaggtagcctgccagggaggagatagaaaacccaagtcaactcccaacccagagcctcaaccacaggcccaggtggccaccttggtggcctccagagaaggataaggcggggtcccacactcactggtgaagagttgctggatgcgaggaaagccactgccaggcccacccaggaggatgctgaccacgatccatgtgacacccacactgacgactaggaccacaatgcggagagggcctggaggcaggatagacacagggtggggtcacctcagataccagcgaaccccagaatgaccccatagccttgcatgactggatctcccctgccacttgggaagaagtggctggaggacaaggaggtggagacctgttgccttctaccagggctgaaagggagacttgagctccctggcaggtggaaggaggaaattgagttcaaatcccaaggctgctgggtttggttttccctggcgggtctgggagggggccttccagaactctctgctcgagaagggctccagccctctttccaagaaccccctcaacttcctgcctctgaaaccaccaatatatttgggcatccacctgcccctgctttcctcctgttctgagggagaagggtccctactcccttttaagaccagtcccggccgggcgcagtggctcacgcctgtaatcccagaactttaggaggccgaggcgggtagatcatgaggtcaggtgttcgagaccagcctgacaaagatggtgaaaccctgcctctacagaaaatacaaaaattagccgggcatggtggcgcgcacctgtaatcccagctactcaggaggctgaagcaggagaatcagttgaacctgggtggcggaggttgcagttagctgagaccatgccactgcactccagcctggcgacagagtgagactctgcctcaaaacaaaaacaaaaacaaaacaaaacaaaaccaaaacaacaacagtcccgtcatctgctgggacctggattgcaagctccccagccttctctgatttcttgtaatagtgatcactctctctagttcgctctttctcctgtattttcaacatctccaatgttaaggaagcaaagaaaacactcttcttcaaaaccacatccccatcctctttcccctaacctttcttttccctgtcaaccccctcaaaagtcatctatactcattccatcatctcacctcctactccctcccaccctactccagtctggcctggcttccaccacctcaccaaatcagcttgttgccaaggccactgatgacctttgtggtgtcaccacccctggtgacctgtcagccttgatcttccttgacctctcagtgggctgcccatgtccacctgacagaagcactaacttctctgctggctttccggacagcacactctcctgacccaatctctctggacactcctcattctccttagttagatcgtctcctctaccctccccttaaaagctggactttcccaggctcccatctcaggctgccttctggtccctacctgtagtgtctttttattttttttatttttgagacggagtcttgctcttgccccccaggctggagtgcaatggcgcgatgtcggctcactgcaacctccgcctcctgggttcaagcgattctcctgcctcagcctcccaagtagctgggattacaggcgcgcaccaccgtgcctggctaatttttttttttgagacagagtcttgctctgttgcccagactgaagtgcagtggcgtgatcttggctcactgcaagctccgcctcccggttacacgccattctcctgcctcagcctccctggtagctgggactacaggcgcccgccaccacgcccggctaatttttttgtatttttagtaaagacggggtttcaccatgttagccaggatggtcttgatctccagacctcgtgatccgcccgcctcggcctcccaaagtgctgggattacaggtgtgagccaccgcacccggccatgcctggctaatttttgtatttttagtagagacggggtttcaccatcttggccagactggtctcgaactcttgacctcaggtgatccacccgccttggcctcccaaagtgttgagattacaggcgtgagccactgcgcccagctgtctttacttttttgagacggagtctcgctctgtcgcccaggctggagttatgcggtggcgcaatctcggctcactgcaacctcagcctcccgggtagctgggattacaggcacccgccaccacgccaggctcatttttttgtatttttttagtagagatgaggattcaccatgttggccaggctggtctcgaactcctgacttcaagtgatcctcccacctcggcctcccaaagtgctaggattacaggcgtgagccaccgcgcccggcctgtagtgtgtttttagatgatgtcatctactcctagctctttaattaagcaccatgtgtcaatgactttctattttctagttccagccgtggcctctcttgaaaccactccctgccagctggttcctcagtggccagctccacctggatatgtccacaaagttaccaccttagcaagtctgaagtccaattcccgagttgtttctactctccacccagccccaacctatccctccccaaggatcttcatcttacttgtccaggtgacagtagggctgtcatcgggttcatgtcgaagcccacagccacttttgtcacttcccctctaagaccacgcctctccacctggactgcccacctcctctctctcaccactcattttccaaaaagcagctggtctgctacctgcgttgggagatactgactatactaatcctcatgtcatagctcggggagctgacgtcctcagaggtgaaaggatttggttaaggtcaaggaacgagtgtttgtgcagagtcctccatttccaaaaccaaacccagtggttcacccgggcctctccagacacagatgtcgcgacgctgggcctccagccaggtgcccttttcaactccctcccgttcgctgtggaagccacccacctgccaacctcatgtccacttctcctgctgggttgggaccgccggcaagtgcactgtttgggggcaaagcggaaggacaggtttgggtgggggtcaggggcaagcctgtgcgggacccctgctgggggcgggcgcgatcggtgctacgacctgtttgtccagccgcccggccaggcagggctcctcggaaacgcgcggggaaaccctgcctggccaggaggggcctcaggaacccgttggctcacgatcttgcccacaggagcctccggggctgggacgaagatgtggttctcctgggctcgggccgttcctccgggcctgggggctggcgatgcgggccgggccggagatttctctggccgtggggagacgtgggctcggtcagggaggttccctgtcaggcccgccgacccgctccgcccccggagaggacgcaaggccgctgcgcagggtggccaggcaggcccggcaatggcggctaagggcggggccacagcccgccggccccgcccccggcagcagctgcgccgtctggctccacgcaggccccgcctccagacccgcctctaccgctcgcgctggccgccgcatgggaggggcctgaacctgtcccgccccgaacctgtcccgcccctggatccctcgtcggccccacctccgcggtgcgttcaggctgaacccaccggccgccgagtgggaggggcccacgtcggtcccgccccggaagtctcccctcggccctttctcgggtgggagagccctgcctacccaggcttagagggctggggctgcgcttgcaccctgaggtcagatttgtgagtcgtgggaagacgcagatggatctggggcagaattagaacctgttccaaagttgatccatgcgctttgtaaaggcaagggaggtacagaggcgcagatagggaagaccgcaggatccagcgtgagcctctggctgcctttccttagggtctgttttctgtccagaagcgcgttcctgctgtctctcgttatcacttttataatgggacggggcgtctcaaactatttcgacatccttgaaaactcttgcctgctccgcctgcctggtctctaacaccctcctcctcagagctgctcaagctgtgttgtttacgccacaccccaccctaaaagcagaggagaatacaactttcgggggcagtggaggggggagtttagcgctataacccgaggctttcacagcaaaccagaatttattttgaggcctctcaggttcagctttcaagtcacgtgactttcgcgtcctacacaactcttattttcacttgaaaacaagtgtgacgtcgtgaattccctaacaataggaaaaaagaaggctccagaaagagcggtgcttggctttcccagcggctccaagcggtgcccggcacccagctggctgtatggacctggggtggtctccggccgcaggcagacgcggcccttcggcctttctccagtcaccccaattctccctgactgcctggctatctcccctccgcgcctgcccgcacgctgcccccaacactgcccgggctccctctgcccatgagaacacgggtcaagctcccgtcccttctgccctgccggctgccccaagtgcgccctgaccacctactgcgctggcatggccggggccaccctgacagctgatccatcatctgtctggagagcagcagcagggcccaatgagaaccacggaaacctccctgccctttgacccaacttacgggaatctcctacccttagggaaacaatgcaaaatatagagaaagtttatagagccgggcatgggagagccctggttagaatccagcagcttctatactggagtactcaacagggtcaaggtccctttcagctgcctgctgctggggccagggctttgcatttgcgttttgtcatggaatttgacagcctctcaagtaattatggtaacgaatcttgggctccatgccctcctcaggggggcccagtcgaagaagctccaggttactcacacccttgagctgccagccggtgtttttcaaagacaatatttacatgttgttcagagcaggcatttatgaaagtgttgctttaatgagtccccctgagcattccgagacaactctcccttccttggggacaccacgtgggtgatgggccagaggcctgggattcagttccacgtcttccgtgcttcctggggcagccttgcaaaagtcccttattttctctgggatggtttggattcctgtgggggtctggccagcacggtgactagagcacatggtctgtcaccatccaggccaacgtcctggggtacactcacagtcatctgttcttccaggtcagccctcatagatcagggcagcttcagcagttctcaaatagcagatgttacaaaatgggggtgggcaatcctgcagcagacgtctctgcactttctgttagaaggacaccccaggtatttttgagcactgttctgaagacggaaaaatccagagtatacatacacttaaagctgggaggggcacctgccggggagaatgcataagggatagaaacaaaaacagagggccgaagcctctgccaggcagaagacactgagttctcagcaaagagaacacctttcagtgctgtggtcaaagggatgtcaagcctcctgaggcccggaaagagcaggaaactgagggcagaattggaaaaaatcaagttacagacacacaccacgggataacctctatacagagaggagcacacccaaaataatactatatatttatagatgtacttttgtattggggtaagacatatataacataacatttgccatccaaatcattttaagtatacgatcctgtggcatcagttacattcacaatgttgtacaaccatcactactatctttttgtgtgtgtgtatattacttttttttttttttccccgagacagagtcttgctctgtctccaggctggagtgcagtggctcaatcttggctcattgcaacctctgcctaccaggttcaagcaattctcctgcctcagtctcctaagtagctgggattacaggtgcctgccatcatacccagctaatttttatatttttagtagagacggggtttcaacatgctggccaggctcgtttcaaactcctgagctcgtgttctgcccgccttggcctcccaaagtgctgggattacaggcgtgagctactgtgcccggccatgtattacttttatgggctcatatatatgtccatagaaatatagagttcttttaaaaattctatcaatagatatttctttttctcttttctttttttttttttttttttgagtcagaatctcactctgttgcccaggctggagtgcagttgcgtgatctcggctcactgcaactcctgcttcccgggttcaagtgattctcctgcatcagcctcccgagaagctggaactacaggcgtctgtcaccatacccggctaatttttttgtatttttagtagagatggggtttcactagttggctaggctggtctcgaactcctgacctcaggtgatccgcctgcctcggcctcccaaagtgctaggattacaggcatgtgccaccatgcacggaaatcaatagatatttcatttccaccaatacagaagcatcagttaacagtgactggttgacacttttagaaagtggcttgagaagggccctgaatgagccacctacgtggaacacagaatttgagatgtgcaaatgtggagacctgaaggcttgttatgggaacaaaaggtggctgtgtatagagaggagcgcagataaaggggacttatcagcagtcgcagggagttcatgctcaacaactggcaacaagcggggcagctacaggctactcaactggggattgatgcgcggtgcctctgaggttcagctctgggcctgatcgtccaagaaagggcagctaaggtgggcatagtgaatcacgcctgtaatcctaggactttgggaggctgaggtgggaggattgcttgaagccaggaacttgagaccagcctgggcaacaaagtgagaccctgcatatatatatatatatatatatatatatatttacacaaataaataaagggcagctagactccacagaaaccatgttgaagattcctgtgcaggaagggggtgataaaatgcagaaacctgacctgacacagccaacacataactgcattgcctcatttttcacgatttttttctttctttttggagagagggtctcattgtgttgcccaggctggagtgcagtggcgcagtcacagctcactgcaacctctgcctcccaggctcaagcgattctcctgcctcagcctcctcagcagctgggattacaggcatgtgccactactggccggctaatttctgtatttttagtagagacggggtttcaccatgttggccaggctggtcttgaactcctggcctcaaatgatccacctgcctcggcctcctaaagtgctgggattacaggcgtgagtcaccacgcccagccattaattgccaagtctcattggctcctagtgtcttaatccacatctgctaaagttgtttaaggtacagctaaaacatcacccaggctgggctcagtggctcacacctgtaatcccagtaatttggaaggcccaggcgggagtatcacttgagcccaggagttcgagaccagcctggacaacacaggaagaccttatctctaccaaaaatacaaaaattagcagcatgtggtggtgcacacctgtggtcccagatacttgggaggctgaggtgggaggatcacttgagcccaggaggtcaaggctgcagtgagctatgatcacaccactgcactccagcctgggcagcagagcaaggccctgtctcaaaaaaataaaataggggccaggcacggtggctcacgcctgtaatctcagcactttgggaggctgaggcaggtgaatcacctgaggtcaggagttcaggaccagcctggccaacatggtgaaacctcgtctctactaaaaatacaaaaattagctgggcatggtggtacacgcctgtaataccagatactcgggaggctgaggcaggagaatcgctttaacctgggaggtggaggttgcagtgagccgagattgtgccactgcactgcagcctgggtgacagagcgagactctgtctctaaataaataaataaaataaataaataaataaataaggctgggtgcggtggctcacgcctgtaatcccagcactttgggaggccaagtgtagggaaaagagagatcagactgtcactgtgtctacgtagaaagggaagacataagagactccattttgaaaaagacctgtactttaaacaattgctttgctgagatgttgttaatttgtagctttgccccagccactttgacccaaccactttgatccaatctggagctcacaaaaacatgtgttgtataaaatcaaggtttaaaagggacctagggctgtgcaggacgtgccttgttaacaaaatgcttacaggcagtatgcttggtaaaagtcatcgccattctctagtctcaataaaccaggggcacaatgcactgcggaaagccgcagggacctctgccctggaaagccgggtattgtccaaggtttctccccatgtgatagtctgaaatatggcctcgtgggatgagaaagacctgaccgtcccccagcccaacacccgtaaagggtctgtgctgaggtggattagtaaaagaggaaggcctcttgcagttgagatagaggaaggccactgtctcctgcctgcccctgggaactgaatgtctcagtataaaacctgattgtacatttgttcaattctgagatcggagaagaaccgccctatggcgggaggcgagacatgtttgcagtaatactgccttgttattctttactccactgagatgtttgggtggagagaaacataaatctggcctacgtgcacatccaggcatagtaccttcccttgaacttaattatgacacagattcttttgctcacgttttttgctgaccttctccttattatcaccctgctctcctactgcattcctttttgctgaaataatgaaaataataatcaataaaaactgagggaactcagaggccagtgcaggtccttggtgtgctgagcgccggtcccctgggcccactattgtttctctatactttgtctctgtgtcttagttcttttctcagtctctcgtcccacccgactagaaatacccacagatatggaggggcaggccaccccttcaccaaggggccaaggcaggcggatcatgaggtcaggagttcgagaccagcctggccaagagaccagcctggccaatatggtgaaacccccgtctctactaaaaatacaaaaattagccaggcatggtggcgggtgcctgtaatctcagctactggggaggctgaggcaggataattgcttgaacccaggaggtggaggttgtggcgagccgagatcatgccactgtactccagcagcctgggcaataagggtgagacttcatctcaccaaaaaaaaaaaaaaaaagcagctccactaggaagactaaaatactaaaatgatggtgtgctaacttgaacagttaggttgttgtacaagaaaggacttgacagttccctttctgatgtcctccaagacatgggttccatttatatgcaccttgttctttcctcagacctgtaacttcagcctggagttgagcagaaacatggcttccttgtcttcaagtcattcttgggcttcagagcgaagatgctggacctttgaaccaacaagcaggttactggtacctttgccctgagaatacgctggtggtgcttgtggctgcagtgtttaccccgagataactttgccatgaagtatcttccttttattattttttcatcgctctagtatatcgactttggaaacaaaagacatcactctatttagagcattcctttcttagtagtggtatttccattgacaaaaaaatagtaattctgaattgccgaaaatgtcaaatcgtagaaaatgttgttagccgaagattcatctgatgaatcagatttttccaaaatagatgattctgatgttagttctgtttagaaataactccaagtacagtttttatatattattttcacattgaaaatcagtcagatttacttcagcctcaaagagtgtgtttatgtaaaaataaatgagcactggcaacctccgcctcccgggttcaagcaattctcctgcctcagcctccccagtagctgaaattacaggcgcccgccaccacacctggctaatttttgtatttttagtagagacgaggtttcactatgttggccaggctgatcttgaactcctgacctcaggtgatctgcctgcctcagcctcccaaagtgctgagatatataggtgtgagccacggcacccggctggcttttcaatggtatatgggaatgagctgcttggtcagctggataaatgtactgtcagcctcaggactgcctgcattcaccctgggaagcagtcaaaccccatgtgatgggtcattgggtcatgagatgctggaacatcactgtattgctggctttggagaaagatagatttttttttttttttttgagacggcgtttcactccgttgcccaggctggagtgcaatggtgtgacctcgcctcactgcaacctccgcctcccgggtccaagtgattctcctgcctcagcctcccgagtagctgggattacaggcacccaccaccaagcctggctaatttttgtatttttagtagagacagggtttcaccatgttggccaggctggtcttgaactcctgacctcaagtgatccgcctgcctcatcctcccaaagtcctgggattacaggtgtgagccaccgtgcctggccaaaaggtagatcttgtctcattttcctgccagaaagctccctgaggctgaacatctgaaaaaagaactcagaaagacgaccccagacatttgctgtgtacagcgctacccagaattatttgaagaaaatgttcaatttccttcttaatctcttcactgactcactggtcattcaggatcatattgtttaagcagaaaatgtttgggaaaaaaaaaaaaaaccaccaccaccaccactaaaaaataacagcactgggtgggtgtggtggctcatgcttgtaatcccagcactttgaaaggccaatgagggcggatcacctgaggtcaagagttcaagaccagctcggtcaacatggcaaaattctgtctctactaaaaatacaaagattagccaggtggtagtgcgtgcctgttaattccagcttttcaggtggctgaggcacaagaatcgcttgaaccaatgaggtgaaggttgcagtgagccgagattgtggccactgcactccaacctgggctacagagttggactgtgtctcaaaaaaaaaaaaaaaaaaaaaaaaagcagcaagacagtgaaacaactatttacgtagtacttatattgtattagatactataagttatctagagatgattagattatttcaagtgtatgggaggactggggagttctgcactttgggaggctgaggcaggaggattgcttcagcccaggagttcaagagcagccttggcaacatggcaagatcccaactctattaaaaaaaaaatacaaatttaaaaagtacacaggaggggccgggcacggtggctcacgcctataagcactttgggaggccgaggtgggcggatcacgaggtcaggagttcgagaccagactggccaatatagtgaaaccccacctctactaaaaataaaaaaattagctgggcgtggtggcatatacctgtaatcccagtgactcgggaggctgagggaggagaatcgctttaatctgggagacgaaggttgcagtgagccgagattgtgccactgcactcaagcctgggtgacagacaagactctgtctcaaaaaaaaaaaaaaaaaagaagtatacaggaggatgtgcgtaggttatatgctgtgccattttatatcagggacttgagcatctgtggattttgatacccctgggggtcctggaaccaatccccgtggataccaagggaagactccactcaactctgccactacaaacagcatgtaagcaaatgggtgtggctgggttcccataaaactgtatttacaaacacccaatgtctacttaggtgagctgcacattgacctctttagctcgttattccttcttgcatctcagattgttccatctagtactgggtttcttctgcttgaggcacacactttttggtgagaaaatgttggtggcaaattctttgcttttgtttgcacttcaccatcatacttgaaagatttttttttttttaagtcggagtctcgctcttttgcccaggctggagtgcagtggcacaatctaggctcactacaacctctgcctcccgggttcaagtgattctgcttcagcctcccacgcagctgggattacaggcaagcgccaccatgcctggctaatatttgtatttttattacagacggggtttcaccatgttgtctaggctggtctggaactcctgacctcaggtgatccggccacctcggcctcccaaagtgctgggatcacaggtgtgagccaccacgcctggccagcgaccatcatgcccagccagccatcattatatcttcaagttttgcttctgccatacttgctgtcttctgtttctgtgaaatcagttaaatgtatggaacaccttctcattctccttgcggcttcttcctctgtctttagtgtcttccctgaacttgtctttctgggttgtattctgaatacattcttctgagccagtttttggttcccgcattctctctttgatgttgcgtaatttgccactaaaccagtccatctacttttaaacttactagctcacattttaccttttttgagacagggtctcactatgtcgcccaggctggagtgcagtggcttgatcttggctcactgcaacctccacttcctggcctcaagcgaccctcccatctcagcttcctgagtagatgggactacaggcactcgtcaccacacctggctagtttttgtattttttgtagacgtggggtctcaccatgttgcccaggctggcctagaacccctgggctcaagcaatctgtctgcttgatccctcccaaagtgctgggattacaggcatgagccactgcacccagctgtcccaccacgacttattatttcattagatctggttaagtacggttattttatgtctggctaacaattccagcgcctgaagacctcacgatctgtcgctattgctcattgtttctcttgcaatgttgtttcctggtgcgcccggttatctctgatgatgtgcttgccctcatgctttaaaaagtacctgtaggaggaaggagtctctcctgagagggtttgctctgggttctgtcagacaggcagaaccatctgcattggggaactgcccatccaggaccccttaagccaagtgaaaggcttaaggttccatggtcaaccctgggaatttgaaccctgggaacttgaaccctgggaatttgaaccctgggaatttgaaccctgggaatttgcaccctggctcagttgcaattctgggtttcctctcagtatgatggggcagcaagttgggggcctcaagatttgatttctgtcctcttcgctttatagggctgtcaaggaaaagttcctgggtgggcaaaggcaacttgggggttaatttgtatcatggggtcctagttttctctgaaaatttggccttgcaaatgtgtgtgtgtgtgtgtgtgtatgagtgtgtgtgtgtgtatatatatatatttatatatatatttgagacagggtcttgctgtgtggcccaggctggagtgcaatggtgtgatcatggcccaagtgaacctcccacctcagtctcctgagtagctaggactacaggcatgtgccaacatgcccggctaatttttgtattattgtagaaacagggtttcatcatgttgctctgctggtctggaactcttgggctcaagcaaaatgcccaaagtgctgggattacaggagtgagacactgtgtccagccatagagtctcactgtccttacagaaagccagaattcagtctgcttcttgttccctcaaagcttcctcgaagtgttctagtggaggcgagcagtgaagctctaggaggcaagaggccttctcagggaccccagctttggcctgtatgtctgggtgtcgtcctggactagtctgatcacgtctcacagctgagtttctcagcttctcctcctgcagtacaggaaggacaatcccttccgactgcttctcacagggagagggcagtggtgagcctagaaaataaaggcccgaagccagccccgccccatttgtgcctctccctcctctccttttctgcttcgcagagcagacaatgcaacagtcgcccccgcccagctcagcctgaagaccccttctccactcccatccctttctggctcagccacccggcagtgggccaggttcggatggagggagggagaggagctggagagagttttaagtactctctgggcttctcacattgctggcttcagtggttgctggacgcaaattgatgtgatgtcagacaccggcagcagagaaggaagctaaggcatttgggtctgtgctgctgtggcacctgggactcagtgtgaagggatcaggctaggtttgaaattctcttccggcttaataatttgcaggtctgggctgggaggtaaagctctgagtacactgcgagtgtcaggggtccggcaggggggctctttccagctcctacccactcccgcgtggggtgaaaccttgagagatgagacaccaatccagggcctctgaagacccacgaggtagagtgcacttaacagtaaattgtgggctgggtgcggtggctcttgcctgtaatcccagcactttgagaagcctaggcgggtggatcacggggtcaagagatagagaccatcctgaccaacatggtgaaaccccatctctactaaaaatacaaaaattagctgtgtgtgctggcgggtgcctgtagtcccagctacttgggaggctgaggcaggagaatcacttgaccccaggtggtggaggttgcagtgaactgagatcgcgccactgcactcctgcacgccagcctggcgaaagagcaagagtctgtctcaaaaaaaaaaaaaaagaaaaagaaaaaaagaaaaaaaaaagagtaaattgtggccaggtgcggtggcccatgcctgtaatcccagcactttgagaagcctaggcgggtggatcacggggtcaagagatagagaccatcctgaccaacatggtgaaaccccatctctactaaaaatacaaaaattagctgtgtgtgctggcgggtgcctgtagtcccagctacttgggaggctgaggcaggagaatcacttgaccccaggtggtggaggttgcagtgaactgagatcacgccactgcactcctgcacgccagcctggcgaaagagcaagagtctgtctcaaaaaaaaaaaaagaaaaaaaagaaaaaaagaaaaaaaaaaagagtaaattgtggccaggtgcggtggcccatgcctgtaatcccagcactttgggaggctgaggcgggcggatcacgggagttcaagatcagcctggccagcatggggaaaccccatctctactaaaaataaaaattagctgggcatggtagcgggcgcctgtaataccagctactcaggatgctgagacagaagaattgcttgaacctgggaggtagaggttgcagcgagcagagatcgtgccactgcactccagcctgagtgccagagccacactctgtctcaaaaaacaaaaacaaaaacaaacaaaaaacccggtaaattgcggggccgagtgcagtggctcacgcctgtaatcccagcactttgggccgccaaggctgggggatcacctaaggttaagagttcgagaccaacctgcccaacatgatgaaaccccgtctctactaaaaatacaaaaattagccaggcgtggtggcgtacacctgtagcctcagctacttgagaggctgaggcaggagaatcacttgaacccaggaggtggaggttgcagtgagccgagatcacgccagtgtagtccagactgggcgacagagcaaaactccatctcaaaaaaaaaaaaaaaaaaaaaaaaaaaaaaaaaagagtacattgcaggccaagcgtggtggctcacgcctgtagacccagctactcaggaggctgaggtaggaggatgcttgaacctgggaggtggaagctgcagtgagttgtgattgcgtcactgcactccaacctgggcaacagagtgagatccagtttcaaaaaaaaaaaaaaaaaaaaaaaaaaaagcaaattgtggctgaattctttggcattgcaggcagagaaggggtgaaaacagggctccagccttgaaccggtcagcaggggtcagggaggctgagtgagtcaccctatggaatgggccagggtggatctgggctcacaggcaagggcctcagtgctcctgtgagctccaaggggctggggaggactgccttcttgttcagggtacagctcgtgttgttttctcgggcttatgtccatgtctcagtgtggacacccgcaactgaggtgacagtggaatgccctgacctgatctctcattctctcccattgtggacccagtgctgtcctcacctgggacctcctgcctccacccaagtaggcgcccagagctgaagggacagttgcctgatgggttcaggtgccagtggatggtcttccacctcccgggttcaagcgattgtcctgcctcagcctcctgagtagctgggaccacaggtgcccgccaccacgcctggcaaatttttgtattttttttggtagggacatgttttcgtcatgttggtcaggctggtcttgaacttctggcctcaagtgatctgcccatcttggcttcctgaagtgctgagattacacgcttgagccactgcgcctggccttacttgggtgttgttccctgccctggaacctaccctgcttagccttaccacaccccatcagcccccagcccaacccgactctcagccttgccacagccccttctggaggccacaggaaccaggacaagaggactaaaaccactgcccctgtggccgaagcctggcccccaatcctgtgcacacagagcccactgagcctgtgacctgtccttggcccccatcaagctcctttccctatctagggtccaggtgaacttggcatacttcctccctctgaaaactcaagaggtgccactccccattcagggcacaggaagagcaagaattgaacaccgggatgcagcatgtgtccctgttgccacaggtctcaccagaggcctccttcgttctacgacatcgggccctgctacctgcagcgcccagggtgcgcgtcctcacctgtgctgcgggtggaacactcctccctggccactttccaggccactggtttgctctccgcaaaggacaaatcccagcaccacctggttattttgttccctgccggcctcacctcctagaacccgggccacaagtgcagggaccatagtgtctggtttcgccatctccctggcaggacacatgctgcactgaaacacccaggggctgtgtggggagcagtgcaggggctgaacagcggcccccaaatacatgtctcctgggagttcctgatgtggccttatttggaaataggaggtctgcagatgtcgctgagttaggacatagaagtcacaccatggggaggccacgagaagacaggcagagtgagtggagtgaggtgaccaccagcccaagatgcctggttccccaggagctggagagggcaggaaggaccctccccttgggcctctggcgggagtgctggatcttggactctggcctccagaactgggagaatcagcctatgttgagagctgcccagtgtgtggcccttctgcctggaaggggtggctgggcctggctgtgcatcactgtggactgtcccctctcccttggcctctgacatcagtcacaaaacccatcccctctccttcctaaatacttctgtggactggcagtgttgctggaagtcatcttgggtggggcagggacatggacagtaagagcggaaggtgaccccacatccttgcacctcaagctggtctcacaatgacaatatgcgtggagcggaggaggactcaggaggtgtctctgacaccaaacatggtcatggctggacatggggtcagaaccagaagtgaggaggctcctcagtggccacagaggaagcacccgggtgacttggggagtgggacaaggaagtgggtcctcagggaagcaaatgacaaggggacaggaggggctgtttgcggatttaatggcagggcattgaggttgggaggggtcccagctgctgcgtctgcttttcttatagcagagaggctgcctacgggtggcacggggtggccatggagtgcagagttggtgggacaggggacatccagggggctcgagatgttgctggtgacaaggaatgtcaagtggcactgaggctggcgggcaaggccacaggcagattctctcacgtgggtgctcgcccctttcctcccccttgtccctccctcccaccctggccccactcaggagtgagacccagtggccaataagctctgggacagacgaatgggcgccctcctccttccttctgttgggctggagtgagtggaggaggtgactcagctcctgggctcaggcagggtctggaggggccaggatggtctcgagtgcttggcagctgaggaatgtagctgggctcgggtagtagcagcagcgaggggcgggccagggtggccagagcccggggccaggaatgtgcagctgaggtcaatggtcccggagtcctcccgactcggggtcgggcggcgggaaggagggtggccgtggcgggggtggaggtgggtgcccagggctcagagcttgtgggggttcacccacttgtaggtgccctcatactggaaacccactctcttcatcagctcgtctgcctccgtggggcctcggctggagagtgacgggtggaggagaggcatgaggtagctccaccctcaccccgcccctgcccgctgggctctgtccccagcccccaccctttcctcacctgccataaatataggggatgggcttgggcttctccagctcaatctggtgcagcagtggggtgaaaatacgccaggcctcacggagctcgtcgctgaggggacatagtatggcttgggaggccggtggcacacagggagggagggcaaaggccaccccatagcccacaggtatgcaggggccggcagctgggcctcacctgcgcacgaagtgcatctggctcccgcagaagacgtccaggatgaggcgctcgtaggcgtcagggagcttcacgttctgtgagggagagagtgtcttgctgatgccactgcctgccaccatgtggagtcccccgggcccaggccgcccaccctccacactgctccttctctgtagggcaccttgtatctgttgccgtaggtcaggtccagctccgactcctcggggttgaagaacatgcccggcttcttggtcatcatcttggtgtacacggcctcgttgggctgcacgcggatcaccagctcgttgcgcttgcactgctggtggaagatgtcgccggccacatcatggaactgcagcctcacctcggccttgcgctcgttcagggccttgccgcagcgcaggatgaagggcacccctacgtggcggaaagggcagcctcagcaccagctctctcagggtgtggaccagtgcgtgagtgtctcagtgggagctccagtgcccgcacacagggcatgcccagttctgccttgctgggcctcgaaggcatcacctaccatcccacctctcattctccacatagaggacgacggctgcaaaagtggcggtggtggacccgcggggcaccgtggggtcgtccaggtaccctttggtggcctcgccctctccatcggggttccccacgtactggcccaggaccacattgttggcctgcacctctgagatgcatttcaacaccttgacctgagagaaagccaagggagagaatgggctccttgggtgttgagttggggtgcagggatgactgtggccacagatgtgcagccctcagggcaggaggaggcccctgcttggctctgctcaccctgccagaggcccagctcagggcccctccctgaggaccctccaggaccaccctggtccatctcgagtctattctgatgaacaagctgaggcccagagaggcaatggccttccctggtcacatagtgactgtcaggcctgggacatgacaacttgggcttcatgactgccagtccaggtcacctccgggaggccacgctgtgctcagaggtggtgacttctccggggttgaggacacctgctctgcatgcacaccccagctcagtgcctcgtcacagatgggcctgcgacagggcatgctcctggggactggggtgcaccccctaccttctcatcacggacgtcatctgagttggtggaggcgggcttctccatggccaccagacacagcatctgcagtaggtggttctgcatcacgtccctggggacggaagaggccagagctcgccttagctccccgccctgttcacctggttcaagggcatggggaccccaaacaaggcttcctagtgacaagctgcaagactcacttcctgatcccccttgtcttccaggtccccttaaatcaaggaaggacatggtgatgctatcactgaatcataaaaccgtggggtgcttggctgtgtaggggtccagccctttccagcccggtctgatagctcagacacttaggttttgaactgcagggtgaggaggagctcccccaagatagggaagagtagccctgcagggtgactggctctgccaccctgtgccagcctcccaggagagaggaagagctctcaccggatgatcccaaattcatcgaaatagcccccgcgaccctcagtgccaaagggctccttgaaggtgaggataacgcaggcgatgttgtcccggttccagatggggccgaagatcctgttggcaaatctgcagggaggggcaaggtggaggaactgaccttgggcctctgtggtgcaggggccacatgtgaggggtcacccttgtctgagttctggaggaattcgtcctcggggaggcagtgggccaggtgaggctcctgagtaccacccccaccctggtcccccggcccaggcttggccccacctcagcaccatgaggttctgcaccatctccttgcccaggtagtggtcgatgcggtagatctggtcctcacggaacagggaggagatgtggttggacagccggtcagagctctgcaggtccctcccgaagggcttctccacgatgatgcggttccagcctctgctgggagcccggagctgcgttacccccttgaacccctcttcggggagtgaggatcagagctgcatcattcagacgccctcccaggggagtagaggccagaacctcctcgcccccgtggccacctcccgtgccttgtgttcccagatgaccctctggctcaacaccttccgggaagccttcccaccctgggtgccagggtggcattgctggcatgctgccgggggcccgttcccctcctgcctcatgctgggtccccggtgggtctgagtggcctgaaggcctgtaggggagcagggggaggaggcatccaagccatggcttcctcattggttttgaaaatgagaagaggacctttgctttactacccccgcattcaaaaccagccagaggacaagagcctctggctgggttgggaaaccacccagcgcgggccatgctgcattcgcagagcaaggctgccaccctgcggcctggccgggcctttggggaagcagagcggaaaggcggtgtttcgtggagcaacgctgccaccttgtggtcccgctggggatggccccggcaccatggatgctgcccagatccccggccccggacacgctcatagagtggtgggagcactgcctgggccagcctggcaggcgggaagggagggcaacggcaagccttacatctggctcatgcaggactcgtgaatgttcttggtgacggcctcgtagacggtcgggggcaaggccaggtagaagaggcggttggcctgtgaccccaggtggagggcattcatgtggctgttgaggcgctggtaggaggctgcatcatcgtactggccagccacataggagttgcgggcaaagaagtcctccagcttgagcttctcctctggggtggcctgggagacacggacagacagacacacagacagatgtcagcccctctctttgagtccgtgtgtgttctgccccaggggagtggagggtcttccctggaggtccagggagggtgccctcagaagtcagtgtccccgtcccacactgggttcagccccatcttagcagctctgcacatccagagggagggaggccaaagcaggcagcacagacactgccccaggctgggacccctgtgccttaggacagaggccagatttcaggatattttgacctgggagaaatacactggagaaagctctctctccaaaatcatgacacccaactatgattggcggagaaaacgcagcagagcacagcaggaggggacctgtgggtcctggtcacgggggctggtaatgggggtctcaaggaagtacgagagcaggcggggcggggcaggagaggaggagagcatcccgggatgggatggggggaggtccccgaagctggccatgctgggggctggtagagagggcagaaccaggctgggggaggccctgacaccacccaccttgaagaagggctcactctgtttgcggatgtcagccactgtgaggcgggaacgggcatagcccacgatgaaggtgttttcgggcagaaggccatcccggaacagccacctgagggcagggcacagctgtaaccagtgcgggcagggcaggaccaggcctgtccctggcgggaggtcacaggggcagtggtgggacacacttaccagatggtggggtagatcttcttcttggccaggtcaccctgtggcagagggaacaggtgtgtggttagaagtggctggggacacgacctacatacatcatcctccacccttggtgatctgggcactactcaggatcactactgggccacaagcatgtctgtcttgcctgatatacagacagaagagccccgagattcaagcctgtgccagccctccatccctgacccagaagacataaacgcatctcctgcgttccaggagaaaacctgaaaattcaattcagtagaaccaagggacgacagaagtaccatgtagccacatttgtgagacgtgacctcaagtgcttacattagcaaaaaagagtggttcaaaaataaggagctaagcattccacttaagaagtgagaaaaagggccagatgcggtggctcacacctgtaatcccagcactttgggaggctgaggcaggcagatcacctgaagtcaggagttcaagaccagccaatgtggcaaaaccccatctctattaaaaatacaaaaattagccaggtgtggtggcaggcacctgtaatcccagttactcaggaggctgaggcaggagaatcacttgaatccgggaggcagaggttgcagtgagccgagatcgtgccactgcactccagcctgggtgacaagagtgagacttcatctccaaaaaaaaagtgagaaaaagatagaactgcaagccaaattaccaggaagaaaataggaaataatgacaagtaaaattaataaaattaaaagctaacccaaagaaaagatgaacaaagctggaaattggtgtttgaaaaagacgaatagaaacagacaaccccctggcatggttgcttttttaaaagggcataggccgggcacagtggcttactcctgtaatcccagcactttgagaggccgaggcaggcggatcaagaggtcaggagatcgagaccatcctggctgacacggtgaaaccccgcctctaccaaaaatacaaaaaattagccaggcgtggtggcgggtgtctgtagtcccagctactcggaaggctgaggtaggagaatcacttgaacccgggagatggaggttgcagtgagccaagattgcaccattgcaccccagcctgggcgacaagagtgaaactccgtctcaaaaaacaaaaaacaaaaaaacaactaaacagctggacgcggtggctcaagcctataatcccagcactttggaaggccgaggcggatggattacctgagttcgggagttcaagaccagcctgaccaacatggagaaaccgtttctactaaaaatacaaaattggctgggcatggtggcccatgcctgtaatcccagctactcaggaggctgaggcaggagaatcgcttgaacctgggaggcggaggttgcagtgagccaagatcaagccactgcactccagcctgggctacaaaagcgaaactccgtctcaaacaaacaaaaaacagagcaatggacctgagaggggacagtggccacaaatcttcctacagaaacaaccccctggcatagagagtgttgccagtgggttctaccaaaatgcaagcacaagagaattccagcctgaagcaaactcttcctgcagaaggaagaaaggggaacacttcccaagccaccttatggggcctacagagccttggtacggaaacctgatgagaaaggcacatgggaaaacccatacgcctcattcacacacacatgcagatgcagaaatcccacacgaaatatcagcaggccgggcacaactcacacaccccagcactttgggagaccaaggtgggaggaagattgcttgaaatcaggaggttttttttttttttttttttaaagacatggtctcactctgtcacctaggctggagtgcagtggcacgatctcagttcactgcaacctctgcctctgggctcaagcaatcctcccacctcagcctctggagtagctgggactacaggtacatgccaacacacccagctaattttttgtattttttgtagagacagggtttccccatgttgtccaggctgctcttgaactcctgggctcaagtgatctgcccgcctcagcctcccaaagtgttgggattacaggcgtgagccacgacgacccactgaccctgtctctttaaaaaaaaagaagaaaacatcagcaaaccaaatcctgcaatgttaaaaacggtaggttttttatttacagaataaatacatctgtaaataaaaagttggtttgatattaacagaaaaaaatcattgaaattcaccatattaagagattaaaaaaaacctctaagaactctctgcctactgctatgttttgattttttaaatctagcaatcttgctcaacccaacagatgtagatcaagtgtttcagaaatcacctattcacgctaaaactcttagcagagggggaatgcaagggaacttcactaacttgataaagggcatctataaaacaccattctggctgggcgtggtggctcaagcctgtaatcccagcactttgggaggccgaggcggggaatcgcttgaggtcaggagtttgagaccagcctgaccaacatggtgaaaccccatttctactaaaaatacaaaacttagctgaacatggtggtgtatgcctgtaatcccagctattcaggagactgaggcaggagaatcgcttgaaccaggaggcagagactggagtgagccgagatcacaccactgtagcctgagcaacagagctagacgtcgtctcaaaaaaaaaaaccaccaccaaaaaacaaagaacaaaaaaacccccaaaccatcatccttacaaatactacaaatatcacacttataggaaatgctgaaatattaatcatccctttaagcaatcaggaacaagaaaagtgcagtaaggcaagaaaatgaaaatggctgaagttgagctgtgaggtggtgcgggtgctccctctgatcaagtgaaacacacacctatcctgtgacctggccgttccaccccaagagaaatgaaagtgcaagtccacacaaagacctgcacacgaatggtcacagcagccttggttcatagcggccccaaactggaaacaagtcaaacacttgaattaacatgtgacccggcaaactgtgcattcatacaacggatactactcagcaacactgggaaatctcagcatcagagatgcaacccattgtgacagaaatcagatcagcggttgcctggagcagggcagattggctgggaatgggtacccaggaactttctggggagatgacgatggcctttattgtgatgagggtgtacagccaattgtacagttaagatttgcgcaccaacaaaagacggcgagaaaaccaacaatggagcggagggtggggagtgggtcagaaatgaccctttgagggccagtgactgtgagagccccaggtgagggggcttcctgggtgcagagcatattctgtttcttgatctaggagcagtttctgtggctgtgctgagtttgtgaaaagtcatcaacaagctagacctgcaccatctgtgttcttcatgacatgtatttctttttttttttgagacggagtctcactctgtcggccaggctggagtgcagtggcgtgatcttggctcactgaaatctccacctcctgggttcaagccattctcctgcctcagcctcctgagtagctgggactccaggcacctgccaccacgcccggctaatttttgtatttttactagagatggggtttcgccatgttggccaggctggcctcaaactcctgaccttgtgatccacctgccgtggcctcccaaagtgctggcattacaggcgtgagccaccgtggccggcccatgacatatatttcaataaaacatggtaaaaactaatagtctgggcgtggtggctcatgcctgtaaccccagcactttgggaggctgaggagggtggatcacctgaggtcaggagttcgagaccagcctggcaaacatggtgaaaccccgtctctactaaaaatacaggccaggcgcggtggctcatgcctgtaatcctagcactttgggaggttgaggtgggtggatcacgaggtcaggagattgagaccatcctggccaacatggtgagaccccgtttctactaaaatacaaaaaattagctggatgtggtggtgcgcgcctgtagtcccagctactcgggaggctgaggcaggggaattgcttgaacctcgcaggtggagattgcagtgagccaagattgcgccactgtactccagcctggtgaaagagcaagactccatctcaaaaaaaagaaaaaacaaaaattagctggatgtggtggcaggcacctggaatcccagctactcaggaggctaaggcaggagaatcacttgaatccaggagacggaggttgcagtgagccaagattgcgccaccaaactccagcctgggtgacagcaagactccatgtcacgaaaaaaaaaaaaaaaaaaacacatgctcttcgaagcaatcaggcactgcaaccatggatgggtccatttctacaaaccattacagaatgggggccatgccaccaggtcaaacgccctcacccagagccaggcagttaggaagccaccacagggcttccaggagggcaactgctatggtgtgggtgccttgtgtgcttgcgctcttcaggggccctgctccacttctgatgctcctcaggtgagctcggtgccaggactacagcgacacggacctctcactgctgcacccttcaaagtccagcagacaacccctcgccctggggtaggagctcctctactcagctcctcacagcacctgccatcagtggggctggggaggggaacgttgcccatgtcacatcaactcacggctggccccacacagaaagggtcagcttactgggaactaactggaccctgaaataaacggaaagaaccacagcctgcaaatacctctaagcctcactcaaagcaggtcatgtttgctcatgaccaaattccggaagactgggaggcatcgggacagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtaagacggacagtaggggtggggtaaggcaggccgctctctcccatggtgacagggagctaagctgagctgagccggactgagctgctctcctcaggactcaggggtagccctgccctcccagctggctgcgatgctctagtgggactttctggaggaacaaacatgggaagacatcgggaaacctgacagcttggtcaagagtctactcgtgccatgtgggtgggggcaattcaaggggtccttagtgaaaagcagttgggagcttctcatcttccccacgccctcctctttcctgaggaccacagcaggggagggatctgcccaaggacacaaggtgacttagtagaagcagggcatgatgaagatctctagccaccaacatctggctaggccagggcaaagggacctgggccatgacctgtctgttttataaaccgaaatcgctgcagcccttgtcttggcatgagggtttcatggtagagcacgatgcctgctggagggccagcgggggtgggccatcccatccccaagggtcactggggttaaggacctgcccagactccctgggtggagccctgggccttggcaggggcccagctggttcctggccactggggccagagaacctgggggctgctgagttagttcagctgaaaaaccaacaaaagggcctccctgctatacccgggggctcatgagtcaccggggctttgggggagtgccaacatcatcatgacacagcaagaatcttatcagaccaatggggaagtcagcccagaaatgttctgaggaaaggggaggcgggggccgctgggtcatccctcccacaggcccatcattgggatgcgtcctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcagtaagtacctcggctccctttctggtaggggtgggagtcctgagaaggcaggaagtggcccacttggtaactctgaggtgccatcagggcccccaggaaggaagctgggtgtgtgggcaagtgtgaggtaagctggccagggaggaggaagggacagaggaaggccacgtgggtccagcctgccccagggtgtcctgcttgcccaggctgtgggtctgccagccacttgcctgctttcagtttctaggtcatgctgagcttgttcccaactcggggctccgggcatttgctcttccttctgtgtttgtgctctcccggccctctttgtgggatctatgcgctttgggggactggggacacagggcccatgtgtatcttctgaaacacacgtcagcctgaactcttgctggtctgcttacttgccgtggttccctggccgcaatagcacataggtcccatgaggagggcagggactggctgctgtggcccagaagtacccaatcgctgtctgctcaatgaacggagaatgggctgctttcctggaacagcagattctaggatcacgtgccctcaagtgccaccctgcctacctcccgcaccgagtgaggcatcaggcgtggaagaagcccgggagccggagctgttccaggtgctgcctgagcacgccacctcccatctcccccccagcaggaagaggaaaaaacaaaccacgaggctcttcagagagaggaccccttgtcccctacccacagtgctggagctggcacttcctatttctgctttgaaagcctcaggttgtcactctcagaacagaggagagcaaaggggaaccctactgatttcaacaaaacaaagttgcccaacccgaagctggccacaggcggaggcagtgaaatgacaaaatcagcttggaaaagcctaaggaccctgggccctcgtttcaaaagctgtcatttgctacacgaaatgctgaggttcaggaaaaggaagacacttgctccaactcacacagcaagcttggatgctctcaatgaggtgtctaataagagctgaaggccaggagtcataagctatcattgtggcctgggttgctctgttgcagtgccttgtgacagcatggggtggggatggagaaagcaacctcagttaccttctcctccagtctgcttcttggactaagggtttaacggtcagagtcctggctgttaaggtttgtggctgatgcaggtatggctctttttatttttatttttttgagatggagtctcactcactccgtcacccaggatggagtgcaatggtgccatctcagctcactgcaacctccacctcctgggttcaagcgattttcctgcctcagcctcccaagtagctgggattacagatgggtgccactacacctaactaatttttgttattttttttttttttttgagatggagtctcactctgtcacccaggctggaatgcagtgttgcgatttctgctcactgcaagctccgcctcccgagttcacgcctttctcctgcctcagcctcctgagtagctggactacaggtgcccacaccaggcctggctaattttttatttagtagagacgggatttcaccatgttagccaggatggtctcaatctcctgacctcatgatccacccgcttcagcctcccaaagtgctgggattacagacgtgagccactgcgcccggcctttttgttttgttttgttttgagacagagtctcgctctgtcgccaggctggagtgcagtggcgcgatctcagctcactgcaacctctgactccctgattcaagcgattctactgcctcagcctactgagtagctgggactacaggcacgcaccaccacgcccagctaatttttgtatttttagtagagatggggtttcaccatgttggccaggatggtctcgatctcttgaccttgtgatctgcccaccttggccccccaaagtgctgggattacagatgtgagccactgcgcccagccaatttttgtattttaagtagagactgggtttcgccatgttggccaggctggtgtcaaactcctgacctcaggcgatccacctgcctcggcctcccaaagtgctgggaatacaggcgtgagccaccgtgcccggccaggtatggctcttctgaggggaccaggctggggctggggctgaggccaagcccaatctactgtgggctccacctggtacctctcctgggtctcaggcttatggggagtcagaggacaatggcccctccttactctgccactggcagagcccttctccctcggctgcctcctcattcccttttggctctccttttctaagttctgatcagaagtacaaaggtgtcaaggagtaggtttgacaaagtgtgacagcgcgttgttctatgtgaacaaagaaccactgagctcagccagcactgaggggcgcacgatgtggaagaactaactagttttgatagagctcctgctcaaggttacaaggtaagttaatggcaaagatggtcatacagtaatgagcagagagattcttgagtgcatccagggttaaaagtgaaaactgagaccacgtgtaatttgagatgaagcccttgttccaccagcccctgcacagtctcactgccccatgggacacaggggagggtgctctagtctcgggcgatggctgtcctaggaccacccctccctcccctcccatggaaatcctcatgctatactattcttttgtctttcctatgagtgcagaatggcggttctacaagctggacaattggggccaggtggggtgaggcagagctccttggtaggctttcgaaattgaggcaaagagacagtgttcaaagaaaagctaagtgtttgtatcgacggaacttgaagtgttagtgaagaggcagagatcaggcctcagatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctctcgggcacctgcgctggaggccggcccgccggctgcctgccatacccgctgccgctgctctgcatccccaattccggcgggcacgggtgcagctccgcgtagtgctcccgaatccccatcgccggccaggccccgcccctactgtccggtttccccgcctgccccggcggcctcgcgcgctcgcggagggctccacttccgccggcagcgtggccacgcctcctctgggctgtccctcggctcctgggcggggccttctgccgcgccactcccccgggaaccctcgcctgttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattagtcgtgcgtatctttggcatagattctgagaagtgacaccactgagcatgggcgatggcgtagatggtacctgagcccccttcctccttggagcttggtttcccatctctccccaccccctatttccctagccttgccaaggaggaggtgggaaagcccgtttgggtttttgtcattcgctaggccatgcagttctctgttaagagtgagcttaaacatctttcctgaggctttaaggaccttttttagttctgcttctgaatgggctgctcatatcatatatatatatgtatatgtatagttgtgtatatgtatgtgtgtgtgtgtgtgtgtgtgtgtatttttttttttttttttgagacagagttttgctcttctcgcccagactggagtgcagtggcgtgatctcagctcactgcaacctctgcctcctgcgttcaacctattctcctgcctcagcctccctagtagctgggactacaggcgcctgccaccacgctcggctaatttttgtatttttagtagagatggggtttcaccatgttggccaggctggtctcgaactcctgacctcacgtgatccacctgccttggcctcccaaagtgctgggattacaggtgtgagccactgtacctggccaatttttgtatttttagtagagatgggggtttcagcactttggccaggctggtctcaaactcctgacctcaggtgatctgcctgcctcggcctcccaaagtgctaggattacaggtgtgagccactgcgccccgctgggctgctcatatcttttatccgtttttctactgggttatcttttgttgctcagcttttagaaactctttgtccatgagcaggattgggtttgtggctgtgatagaaattgcagatatcttttcctgctttgacctcgctactagtgtttctttgttttttgttttgagataaggtctctgtcacccgggtgggagtgtagtggcacaatcagagctcactgcagccttcacctcctgagctccagcagtcctcctgcctcggccttgcgagtagctgggatcacaggcgtgcgccaccacaccctgctaaactactggtgcttctcagcctcgaagtttttttttctttatgtagtcacatttatccattttttcccccttttactgctttgactttggagtcgtcgtgaccaccttgtggtctgtgggagggatgcttcacacatgagcacttttctttttctaacaccgaagcgtgctcttgtcttcaccaagagtgttgttgcccagtgtgactggtgatggctgtttcatcatattccagaagtttgtgatgccatttcccacactggccccaattaggaagaacagacgactctacttgttttgcaagattctggaaatttcccggggtgtcagagccctgggcattaaccctgcaattgtagcaaaggaaacaaagttggaagttgactccccagcacccaggccttccttcctgccctcctccaagctgccctggttgggaacgggatattgtgaatccaccctgaggcttcctcacagggcttcctgctatttgacagtgtgaggctggctagaattgggatatgaggccttctaaaaattaacctggcctgagggctttctcagcatctgggggcggggtgtgggggcggggagtgacctttcccctccttcaagccaggtgcccatcagattctacttgggaaaatgtgaaaggcacagacagcttgtctgctcacgggtgctgcacttaaatcctaatcttgcaatttttctacaagagcactttacattttttttttggagggagggtgtatgagtagacggtggctgctgtaacaaaggactgcacacttggggcttaaaacaacagaaactccttcacagtgttggaagccacagtctgcaatcaagttgtcagcaaggctggtttcttttttctttctctttctttctttctttctctttctttctttctttctttctctttctttctttctctttctttctttttctttctctttctctttctttctttctttcttttttctttcttttctttctccctctctctctccctctctctctcctctctctctttctctctttctttcttgttggatacagtcttgctctgacacccaggctggagtgcagtggtgccatctcagttcactgcaacttacgcctccagggttcaagcaattcttgtgcctcagcctcccgagtatctgggattacaagtgcccgccactatgtccggcaaggctggtttcctctgcaggtgccaagagaatcgtttacaggtctctgtcttagcctctgctggttgcttatagagccatcaccctagtctctgcctctgtcatcacacagtctcttcctcttcgtctgtgtcttcccttttgtctcataaaggacaccagtcattggatgtagggcccacctggataatccagaatgatctcctcatctcggcattcattacatctgcaaagacccttttcccaaagaaggtcacacccataagatatgcacgtatctcttcagggccatcacacaacccagtatggggacatgttccagtgcacacagatgagggcaaatgcagcagcagtgcctgggagctggaaaaacacccctgcttgggccccctggaccaaccgagtcagaatcttggtctagacccaccaggcattggtctagacccaccgccctgcccggaggtggggctgcctcctccctcctccggtagcacagtgtagggttgaccgtacaccagacaccaaggatttaaaaccataccatttgcgcagaagtacggcattccagggttttccttttcggctttacttaggttgagcttccagaacaactggttggattactcttgggagggaaccagcctgcctgccctattggctgcggccccttgatccacaaacgaagcccatccctgccggagcttgtggcgttctctggtgttcatgcgcgctccccctcctgccgaccaatgcacaagaacagtgcgggcgaccagtaagcacagtgagaaagcatttcaccctcatcagtaactaaaacaacagcaagtctgacagcaagcaaaaagtgatctgaaaatggcaaccgatgaagccctaggtgagcgctctgctggcaaggtgcaggacagcggcccttgcaatgctgccctttccgagggggccatttgctgggatggagcaagcccgtaggcagcgtcctcagccctggtgcgtaaccctaagagagagtcgggcactcagcgatgactctggcattgggaaggtgcttcacttcgtcatttgtagctgccaaaggtcggggtgagataagaggctgcgtatgtaacgatgtggtccggcacagctggcattttgaacatctcctcacacgcaacatgccttgtagcatgttggtgtgaacaggccaggtgacaaacttatggataaagcgtgaccccaatagagaagtaaaagctctgagtgcataccctgctaacatttggacggacgtgagtagctgggtggccagtaatgagaagttttccttacatgttagtacctttcctaaatgcctatcatttgcacgcattcctttgatacacagagaatacgtcttcccacacagtcgctcgggtggtaacgcagcttggttttcttctgtgccagtggcagggaagagcccgctgttgacacagcctctcagcaaggcacggggcaggggctgactgtgtctcctggggctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttccgagcaccatcattttctcctcctcagaccccttggttctccttccacgtcctggcagctgcttcgcaggctccttgctggttcctgtgtctccgagctgactcccgaattctcttcctctccttgctcagacactgcccctttgtgacctcgtccatcttcaaggccttgatgctgatgacagatttctgtcttccagtcccgatctgttccttcacgaaaatgagcccagtagcccgtccaagccagaaatggacttttagcccccaccccctgccaactctgccctttccctcatccccagttgcttaaaccaaaacggattcctcttcctctcatgatccaaactcctgagtcccttcaccttttgcctacactatcacagtgacctccttgctgctttcacactggagagcgtgggctccctgtgatctactctccacatggcagccagtgtcatctggtaaacctttgctgaaaccctgccatgcccttcagttgccctggaaacctgaactcatcctcagcctggctcgcagagccctcatgccgctgggacgtcacgttatgtccctctcctgctggcccgctgcacccagccgcaccacatgccggccgcacctcacacacgctggcctcttggcccttcctcgaacacacggcgcttgtccttgttgtcccctcatctttgcatggccgatttctttttctcattcagctctaagtttaaactttcaacagttctaagcgtatcaccttcttcatcttaaagtcctcatcctaaatcacactgcactgttttaactcccagcttggcagtccaaacggcctcatttattctgctttgttttctctctccttccaccagagggagagcagaggcctcctccagctcagtcaggcaccatcccccggaacagcggtctccaacctttttggcaccagggaccggttttgtggaagacgagttttccacagacggggatggggcgtgggatgacggttcggggatgaaactcttccacttcagatcatcaggcattagtcagatgctcctaaggagcacacaacctagatgatccctcgcacacacagttcacaatagggtttgcgctcctgtgagagtctgaggccgctggctgatctgacaggaggcagagctcaggcggtcatgcgagcaatggggagcagctgtacacacagatgaagcttcgctcgcgtgcccaccactcgccgcctgctctgtggctcagttcttaacaggccacagaccagtatcggtccgtggccggggggttggggacccctgccctagaacgatgctcggcacagctacactcggtgcacatttcttggtggcctgagcttgtcttgagctccatcaggatttctctgtcaatatttttgtagaccataccctgtcaccataaatggtgcttggtagaaatgactgtatgcatgtgatagggataacacagaaaacccatggtagagagcatggcgactaacttggagggacttctttttgtctttttttttttttttttttttttcgtttttgcagagatgcaggtattgtcatgttgcctgggctggtctcaaactcctgggttcaagcaatcctcccacctgtgcctccctaagtgttgggattacaggcatgagccgctgcctccccgcagcatggggggacttcttataagcatttttatttatttatttggaattcggatggatagatcatgttggcctgataatgtatgtgcaagagcacagactctggggtctcatggacaagccccactctgccccttgcttaatgtctctgagcctcagtttcctcatctgtaacaagggcagaaatgccatccgtgtgcagcagagtaccgacgaaaggatggatgcaatgctcttatggcagtgccccacccaaggcacaaggaaaaaccacgaaagcaattccagtttacaccacgtcccaaactggattttccattcgactataattcctcccaataagggctcaaaacgttgtctaaggaaagtcgattggttgttgcccagggctggaggagttgggggaaaacggggagtgactgctgatggagacagagtttccttttgagatgatgagaatgtcctgaagctggtcatgctgatggttgcacgtatctatgaatatactaaaaaccatcgaattgtacactttagacatgtgaattgtgtagcatgtgaattaaacctcaagtcgttattttaaaaatgttgtctaagacacctgggcgcctcctgtaagctcccatgaaaatgcaaatgaagacacagaagaagatcaacattgaacatttacatcctctcctaaagctatgtttgacaggtgacctttttttcatccttccttccttccttcctcttccttattccttccttccttacttcactccctcttccttattccttccttccttctttccctcttccttattccttccttccttctttccctcttccttattccttccttccttctttccctcttccttattccttccttccttctttccctcttccttattccttccttccttctttccctcttccttattccttccttccttctttccctcttccttattccttcctttcctcccttcctccctccctccctccctccctccctcccttccttccttccttccttccttccttacgttttttaacagtagagacaggttctcactgtgttgcccaggctggactcgaactcctggaaatcaagtgatcctcccacctgggcctccccaaatgctgggattacaggcttgagaactggcagggagaatgggcgactgactttgtgttgtgaagcagagtgaccctactctgtcctttcctcagagacccagggttggtaccaaccaggagactagcagctgctcttctacccggcccaggttgctttctctatagtcattgagagggaaaccctcaaacagaaagtgtgtcagcagggggcaggcagctgatggatgtcattgtacccttggaggaacagaactcagcggtcacaggaagcggggagatccagggattccatcggtcgcgttggttccgagtgtcgcaggcctgaggggaaggggtgagatttgctttctcagtctaggagagccaaagtcgacaaatgtgtgctatagctggaaataagtcttctcccgcacctagcgggcggtggtcagggtggtctgtctgtccatccccgaaagcactgcaagacctgccatctgtttctggtgatgctgggtggtattattgagacagatatttctgctgaaaataactgcaaatgatagatgaaacagtttgagactgttcaaaacagctgagaaccaacaagagagcaaaacctgagaggaagtgggaatccaagaagaagtacgccactgaagctgcttatttcccgaggacgctggccgacctgggcaaacttgggttttggttctggaggccgtccaggcaagggagacagcaggcaaggcccaaagcctttgtgaagtgtggggagttgtatagcagcccccgctacgttaaggaaaccccaccccagctctgcagattgcggggaagcaggagatgaaaggaaagggaaaacacccctgtgcaaagttgtggccaagggccaggttctgtgcagacttgcagtctaggttttcctggtggggccgttcagtggccctcgagtcctaaatttggtctgaggtggtcctgggccgacagtacccatattagttttctagggctgccgtaagaaatggccacaaactgggtggccgaaaacaacagaaacggattctcccgtggttctggaagctacaagtctggaatccagctgtcagcagggttggttcctactggaggctctgtgggagaatctgttccatgcctctctcgtagctccaggtggtttctggcaatccctggcactctctgtctcatagagacaccgctccaatctctgcctccttcttcgtggggtcatcttcccagtgtgtctgcctctctctcttatgaggacactagtcacatttgattagcgcccaccccaatctagtatgaccttaacttgattacatcggcaaagaccctatttccaaatcaggtcacattcccaggcacccaggtgttaggacttgaacatacctttttgggggacacaattcaacccacaacggttaccccaacggatgtgtggattcgtgggagcctggggttgagatgcagtctccacaaaagttcctgagtgagagcatgtcctttgcaggagcgtggatggagctggaggccattatccttagcaaactgacgcaggaacagacaaccaaataccacatgttctcacttataagtgggagctaaatgatgagaacacacggatacatagaggggaatgaaacacactggggccttttgcagggcggaggttgggaggagggagagtatgaggaaaaatagctcatgggtgctaggcttaatacctaggtgataaaataatctgtacagcaaacccccatgacacaagtttactcatataacaaacctgcacatgtacacctgagctcttaaaataaaaagagcgatgtattaatataacaactttaggagcactgggggaaaaaaagttcttaatgacactgagcagtgcacataaaaactaagcacacccagggcaggaaagagaccatgagactaagagttcagatgctggaggctgggtgcagtgactcacacctgtaatcccagcactttgggaggccgaggtgggcagatcacaaggtcaggagttctagaccagcctggccaatatggtgaaaccccgtctctactaaaaatacaaaaattagccgggcgtggtagtgggcgcctgtactcccagctactcgggaggctgaggcaggagaatcacttgaacctgggaggtggaggttgcagtgagccgagatggcaccattgcactccagcctgggtgacagagagagactcaaaacagatgctggagcaccacacagatgacagaacaactgaactttaaaaacttaaaaaaaaaaaaaaaggcttgtgaatatccacagggaatagggaatatatatatccaaaaagtaaaagctgtctaactttttatttctttgtttgtttgtttatttatttgagacagggtctcactctgtcacccaggctggagtgtagtggcacgatcacagctcattgcagcctcaacctcccgggctcaagcgatcctcccgcctcagcctcccgagtagccgggactacaggcgcgtgccatcacgcccggctaattttttattttttcgtggagatggggtttcgctatgttgtccaggctgctctcgaactcctgggctcaagccatcctcccaccttggcctgccaaagtgctgggattacaggcgtgatgaactcaatttatttttctctttctaaaaaatacccatttgctttctctgtcccctgaaaagccttcaaagcaatgctaatgccattgcagctggcaccaagactatggactgaagtgctccctctggaggtaaatctgagacatgaccacagcgtttgtcaggaggacactgctgccaaccaatttgagttgccattggctacgaatggagcatcagaaggaataatggcccttcctgccggctgctctgctggtcttccttcctgcctctcttcctcggtcctgtccttctccccctcttcttccaaaagcccctgggattgggggcccactcaaggaaagcgtggagggcagctggggaccagtgtgaagcacgatcctccgctgagcgcagcagtgtcctgcacaaggaagttttgtggagtaaggaagggagtcggcgagggtgactgtgtcctggggaggggtcaggggtccaagagaggaacgtgtgccaagttgggtggtgacctgatgggctcagatggttgactggctttgcagtaaatatatgaatgatgtagggacctggctttctcaccgtttggaaaaggagttgcagatatgaaaagagagaaggcttgaatgtggattcgatttggagttgttggtgtgaattcattgatctagtttggatgtttgtccccacccacatctgatgttaacttgtaatccccagggctggaggtggggcctggtagggggtgtttgggtcatgggggtggatccctcatgaatggcttggtgctgtcttcgtgatagtgagttctcgagagatcttgtcattttaaagtgggtggcattccccccgccccgacacacacactctctctctctctctctctctctctctctcgcttgctcctgctttcgccatgagatacacaagctcttgctttgcctcccaccacaagtagaagcttcccgaggcctctctagaagctgggcagatgccagcactaggcgtcctgcagagcctgcagaaccaagagcccattaaacctcttttctgtataaattacccagtctcaggtatttctttatagcggtgcaagagtggcctgatacactgatggctttcaatatacagataggtatagaaataagcatagctgtaaaatagggctgtgtgtatgggtatttctcagctccatcacttagaaggcctgggaccatctcaatagcagtgagttgacttagtgcctgggtctcgatttctaaacaaccgtcttgattaaaaagaacagagctcactagagaaatgactgattccagggctagggcagagaaagtccaagattaactggatcatcttgttgtcccagaaaaataaggaagtgcttaaagagcaacggagacacatttagctggactaagacagagagagcgaggactaaaatcagaaatgaaagtagccacattactactgaccttacagaaataaaaatatgcatgagagcacggaaacgtatgacttcctttacttcattctcctcctttacttctgagttggtcaagaattagaagcaagagtttgggaacactttgctaaaggggtttctattcactgttgcagatatagctaagctatagatatagatatagatgatagatagatatagatatagatatagatagacagatatatagagagagaccaggtctcactttgtcacccaagctggagtgcagtggcatgaacatggcttattgcagccttgacttcctgggctcaatgccatcttcccacgtcagcctccagagtagctgggaccacaggcgtgcgccaccgcgcctggcaaattttacaattttttgtagagagtgggtacagccatgttgcccaggctgctctcaaactcttgggctcaagcaatctgcccagctcggtctcccagagtgttgggattacaggcataagccaccatgcccggccaattgcagcaataatattcttttgcaaaaaatttgttcatcgttggtaccgaagagctgttgaacatcctattattgcacaggaggcatttatcgtggtacaggccagggttttctgccccaatcagggtctgatgttacgaggtacgtggagagatgggtaaccttaacagtgtcacctttttcttacttttccccaacaactcatctcatttattcatgtttgtgttttgcagacaattggaaataacacgtcacagttacaagcaccattacatatgatggtggtatttctgatcctagacaaagaccacttgagttcattacaacccctatcagccatggtactttgggccagtcactcagcctctcttagttttagcttccacgtctatgaataggatgacaataatattctgcatgcttgctctgaggatggaaaagataatttccctttttttagagtcaaggtctcgctctgtcgcccaggctggcaggagtgcagtagtgcaatcacagctcactggagcctcgacctcctgggctcaagtgatcctcccacctcagcctcccgagtagctgggaccacaggcatgagccaccatgcctggtgggaaagacagtttttataatgacttttatcccttttattttttgacaaaaccatgtttttgttcactacttcaaggtgaatgatgtcctcccagttccaaatctagtgtctgatttgagggctagctagccactggatcaacattggaggaaaaacagctgttctctgatttgatcttatgcttaagcagatttgctggaagcttgcacacctgttatctttgaaaaaataaattggttattggttaattttttccccaaaccgtgatacaatgagttatgattatagcatgacatacgtgtacacctcaaaatcattgtgtagtacaaatcgcaaaacttataggaaaaatggggttagggacacaatactcaaaacctttgtcagtgacacataaaaaaacgaagataggaacctaatgaaaatggtagcacaattctatgcatgttaaatggttaaaaaatacctaagtgctgcagcaagtacggcacttcaccttgaaaaagacctgaagtttgcttgtggaaatggcggtggaagggttgcaggtcatgaattggtgaaaggagggtgttctgaaattggacagaaagttgtaacaccagatgcggactagtgtggcttataatacgtgtgctgagccgagggagtggaataaggtgggaatcccctgggaatttaagtgaacactgatcaaaatgtttgtttcaaaccaattctcttgtattcattacgttggcatttaggaatgaagtgatgtttccatgacctatgttgattgaaagaccaaagattttgtacctgttgagtctatgtctttacagtgcagtaaatttgtacttctgagtttaaagattaggtcaacaattgggtatttagcaaggcactctgggaaacagaaaaactataagacagtctctgcctccgggcgaccaactactttttaaaaattcaactggagtctatataaaagaggaaatgaaggcggcctggtgcagtgtggctcacgcctgtaatccctacactttgggaagctgaggcgggaggactgcttgtgtccaggagtttgagaccagcccgggcaacatagtcagacgccatctctacaaacaattttaaaaaatgagtcgggcgtggaggtgtgcacctgtagtcccagctacttaggaggctgaggtgggaagatggattgagcatgggaagtcgaggctgcagtgagctgtgattgcaccgctgcactctgacctgggtgacagagtgagaccttgtctccaaaaaaaacaacaacaaaaagaagaaatgaaaatctagaaaaatacgtgaaatcttttcctgtcaaatgtttccccctaagctttaatgatcctatttcattaaaggaaatatgggagaatattgatgactggcagcacgtagtggttaagagcaccggactgggagctggaagagtctgtgattcttgaactcctgggctcaagcgatcctcccacctggatctcccaaagtactgggactacaggcatgagccaacatgcatggccgagtctgtgattctttactggaatggagtgacgtgtgttttcttcttaaatgacatcgtgaatttccaaggtccttgaaatctctttgcatctctttccaatttgccattgctatgcctgaagttcagttggaatgcttatatttcagcttatcacattacctatattctgatcaaatatgttatggcatcgaagctaattttgagacatggtccctaggccgtgggacctaatgaccagagatggaagtctatgtgctgcttctgtcccaagggagatgagtatctgttaggggctcactcgggactgtgtggtgctacctgagtgcgacacagatgctggagacttgagaagatatcactgtagactccaaccctgttatagctgatgaggaaaaaactgagagtatttattattgcccccacaaaatgcacatattttattatattgataagatgtgaacaatatgttattcctcaatattctgcaggttgccttttcattttgttgattgttactgaattcttctacccccaaaaaggattacatgagaagattgtgaacaattgtttgccaacaaattagataacctagatgaagtggacaaattcctagaaatgtacaaaccatgaaaactgactcaggaagaaatagatttcatttccttcagatctatacccagaagtgggagagctggatcatatggtagttctatttttaattttttgagggtcattcacaggcctggaggctgaagagggaagaatggttttttggacccagcccagagccctgctggcctgagcaccctcgggacactgctatctgcgccccagctgctccagctccagccatggctacaagggccccagatacgcctccggctgctgctctggagggtgcaagctgtaagccttggtggcttccatgtggtgttaagcctgcgggtatgcagagggcaaaagttgaggcttgggaacctctgcctagattcagaggatgtatggaaacgcctgaatgtccaggcagaagtctgctgcaggggcggagccctcctggggaacctctactagcgtagtgcagaagggaaatctggggttggagtccccactggggcactgcctagtggagctgtgagaagggggccaccatcctcaagacccccgaatcatagatccactgacaactcgcattatactcctggaaaagctgcagacattcaataccagcccaggaaagcagccgagggggctgtaccctgcagagccacaggagcggagctgcccaaggcctcaggagcccaccccttgcctcagtgtggcctggatgtaagacatggagccaaaggagattattttggagctttaagaattaatgacgattttctgctccgcccgcccacagatgtagtttcctccgcacgtgcgcaccttccctcctccccgcctgcagggtccatggcctccatggcgttttaggggcagcagtgcctgtggcagccttggcctttgcagcggtggcagcagcaccaggctctgcagtggcatccaccggcggcttaagccgtagcacttctcacagcattcagcagcagcattgctgtaaccgacaaagacaccttcgaattaagcacattcgttgattccagcaaagcactgcaccatgaccgagatgagcttcctgagcagcgaggtgttggtgggggcttgatgtccccccttgaccagtcaggtttggggactgaagaaagcctaggtctcttagatgactacctggaggtggccaagcacttcaaacctcatgggttctccagcgacaaggctaaggcagactcctccgagtggctggctgtggatgggttggtcagtgcctccaacgatggcaaggaggatgctttctttgggacagattggatgttggagaaaactgatctgaaggagttcgactttgatgccctgttgggtatagatgacctggaaaccatgccagacgagcttctggccacgttggatgactcgtgtgatctctttgcccccctagtccaggagactattaaggagcccccccagtccaggagactattaaggagccccccccagatggtgaacccgatttgccatctcccagaaagtttaacccgaccaggttgcccccttcaccttcttgcaacctcttcccctttccccaggggtccagtcctccactccagattattcctttagtctagagctgggcagtgaagtggatatctttgaaggagctaggaagccagactccactgcttacatttccaagatccctcactgcacaaaggaggaagacgccccctcagataatgatagtggcatctgtatgagcccagagtcctatctgggctctccctctacctccaggggctctccgagtaggagcccgccatctccaggtgtcctctgtggctctgcctgccccaaaccttatgaccctcctggagagaagatggtagcagcacaagtaaagggtgagaaactggataagaagctgaaaaaaaaatggagcaaaaccaaacagcaggaactaggtatcgccagaagaagagggtggagcaggaggtcctcactggtgagtgcaaagcggtggaaaagaagaacgaggctctgcaagagagggcggattccctggccgaggagatccagtacatgaaagattcgatagaagaggtctgcaaggcaagggggaagaaaagggtcctctagttgagggtagtcaggagcgtcaatgtgcttgtacataggagtctcgcgctgtagctgtgtgttcgaataaattattttgtagtggaaaaaaaaaaaaaaaagaattaatgactgtcctgttgggttttggacttgcatggggcctgtagcccctttgttttggccgatgtcccccttttggaaagggagtatttacccaatgcctgtacctcaattttatcttggaagtagctaacttgttttagattttacaggctcataggcagaagggacttgccttgtctcagttgagactttggactgtggatttttgagttaatgctgaaatgggttaagacttgggggactgttgagaggagattattgtattttgcaatgtgagaagtacatgagatttgggagggggcaggggtggaatgatatgatttggatttgtgtccccacccaaatctcatgttgaattgtaatccctagtgttggaggaggggactggtgggaggcgattggatcatgggggtcgatttcccccttgctattctcgtgatgttgagctctcacaagatgtggttgtttaaaagtgtatagcacctcccccttcactttctctttctccttctctggccatataagatgtgcctccttcctctttgccttccgctatgattgtaactttcctgaggcctccccagccatgcttcctgtagagcctgcagaactgtgagtcaattaaacctcttttctttataaattactcagtcttaggtagtcctttatagcaatgcgagaacggattagtaccgtcaatattgatgagaatgttgagctatgtgtatgtacgctgacacattatggtggaagcgaaaattggctcaaaccacttgggaaaacatggcattatctagtaaatttcgagatatgtattggctgtgatacagcaattccaaaaaaaaacttggacatgtgcttcaagagacctgtacaagcatgttcatagccaagggctggaaactatccaaatgcctgcccatcatcagcagaatggataaattagaggactataaaactctgccgtaatgtaataggtagtttccaagaaatccaatcacatacaatgtgaaaatgtgttactgtggggttaatgaaatgaatgaggcaagcccgctggaccatccaaatctgtcctgctcccggctggagtttgatgccatctagtggcagacgttgctctggctgaaatattgatggagatttccggtccagtggctggctgagacttccaggacagtggcagtatctccaggaatctctcaatcagttaggacttcctttcttgacttgatctgaggataataggccgggaaaataatggggacccggagaccctccctctgtcttcctgcttcctaagacagggtcacatgcactttactctcccttccctgacctgttgaaggtaagaactttagcctgcctctgtctgagaatggggagactgagcagaggacgacaggaaggatggcaatcactaaccgggttatgtctgattttcagctattccaggtgttaacaagttgtgttctctggtttttaaaattcatcatttaatgaaatatatgtaatgaaatacagcagtgaaaataataaactggaggtacacgcaagagcttgggtgaatttttcttttctgtaagtaaaaacatttttaactgatgtatgataactctgcatatttatgggatacatgtgatattctgatacatgcacacgcacacacgatgtaatgatcaagtcggggtatttaggatctccaccacctcaagcatttatcatttctttttttggggaacatttcctatcttttagctattttgaaatatacaataaataattacctatagtccctctacggtgctatcaaacactagaacttaatccttctatgcaactatatgtttgtccccattaacctccccaccctccccacctttcccagcgtctggtaaccatcattctgctctacctccaaaagatcaacgtttttagtttccacatgagtgccaatatgcttttcccaggtgcagaggctgctgattcctggatttggaaggtgggggagagtggtttggatttcagtacctcccccttcctcagggctaggccctgtctggtcacctcctgttgctacaggtgtgcctggcacagacattcagctcccggggccgtgccgccctcacccctgcatgcctctagaggtacctgtcccgtggatttgacccccttccagacacacaaatagatcaccactgagcagacacagggtcacctcccagctccctaccaggcaagagcgaccagggcagggactgatactgccgaacccaggagccaggcccgacccagcctcaggtccagcaggtcccgcctgtccacctgggccaggcctagagcccgggagcccctggctggtgggaggccacccgcaacccaccccacacgcagctccagctcccccaccaggcggggcgactaggacagggacagaacccgttgaacccaggagtgagatccggccccgggtcccgctgggccctcccgtccaccttggctggacctggcgcctgggagaccttggctggcgcgaggccacgcccaccagacatgcagttccagctaccccaccagctgggcgaccaggacagggacggaggctgctgagcccagttagaggcctgccccccggggtctgtcctgggcgctcccccaaggacggacagggcaggcagggtccgggacgatggccgcacagtcccggccccgtgttcccaggcccgtcttgctcctcgatgtgagggagacccgggggatgggacaggctgggccccgcagtgcctgactccctgcagggctcccgggacaggggtccggcggacagccggctgctcaggggtgaggggtccaagctggcattgcggccaccttccggcccgggctctcttggggaggggcggggttggtgagaaccggtcacgtgctccggggctcactcggggtctcccagggccggaagtagggcccctgtgcgcaggcgccctgaggatcccgggctgcccatctcacgccagggggcggaacttcctgcagcctctctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttgtattctgttctgttctgttctgttctgacagttctggtggcgaggtgggggccgggagatggggagggcagggccaggtgggggaggaggcgggggagatgcgagtaagtggttgggtgggggtgggggtgggggttgggaggtggggatatgagaggccagctgcgaggaggggaggaggtaagggctgggaggtagagggggtgggggtgggggagaggggctgggtgattgggtgaggggcaccgggtcatgcggggaggggagcaggggccaggagatagggggacccaggtgtaggaggggatcaggaggtggggggaagggggcaagatgggagcgggtggcgggaggtggttgggatggagggtcgagtgatgaggagggggccgggtgatgccacagggggcagggtggggaggggtcttgtaagggcatggaggagtcagcttggggtgcagcaaaggaaagtggggaaccaagacagctgggtggggtgtgctactgggccagtgcctggggagacagcctgggggggatgggctgggcaatccggggtaggggggaggggtgggggagtgggggagggggaagctggcctggggtaagcagcaggccggagccacaggccaagtcctaggagaggatgccttaactgggcccccaccagctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgattccgtgtctgagtctcttttcggcgagcgaaggcaccttcggacttgcatgcccttgtcctcgggttgcaggggaggctctgggattcacagattgaagtagcacaaggtaacgggaggcaatttgggaaatgggggaaaatgaaaagccactgggtcccgccattcagcattaactactgtggacattttagaatattttcctcaatatacttgcatttatatgttaaatatatgacagtagcatatataatgtttttccaggtcagcattaaattttttcccaaattgttttcattgaacatatgagcttttttacttgggaaaaattctttgaaaacgtacttgaatagatgcatagaaccagcattatcatatcactgttaagcatgtgatatgggttgggcatggtggcccacacctgtatttccagcgctgtgggaggcttgaagcgggaggatggcttgagacctgcagttggaggccaccctgggcaatgtagcgagattctgtctgtagaaaaatcattaaaaggccgggtgcggtggctcatgcctgtaatcccagcactttgggaggccgaggcgggcggatcacctgaggtcaggagttggagaccagcctggccaacatagtgaaactccatctctactaaaaatacacacacaaaaaaaacaacaacaaaaaaacattagccaggcgtggtggtgtgcgcctgtgatcccagctacttgggaggctgaggcaggagaatcacgtgaacctggaaggtggaggttgcagtgagccgagatggtgccactgcaccccagcctgggcaacagaacaagactctgtctcaaaaaaaaaaaaaagaaagaaagaaaagaaaagaaaaaattagcagggtgtggtggtgtgtgcctgtgatcccagctacttgggaggttgaggtaggagaatcacttgaacccaggaggtggagggtgcagggagccgagatcatgccactgcactccagccaggttgacagaaaaagactctgtcaaaaaaaaaatttttctttaaattaggtgggtgtggtggcaggcacctgtagtcccagttactcaggaggctgaggtgtgaggtggaaggatgtgttgagtccaggagctggatgctgcagtgagctatgaatgcacccctgagctccagcctgggtgacagagtgagaccctgcctctaaaataatgataatagtaattcaaataatctaaaatctttgtgaacatgtaatataaccaaaacacaggttcattccctcatcgcttggagatccaattaacaagagcgtggtctgctataaagaaacggactttctgccatgcttgatttaggggaagacgtacaggctcctgcctttaagggtgctgcttcccactgggggcagaaagcagggccttttaaaggaggacttggcgtgaatggtaggcaggggagggagcaggcagctgtggggtctgcatgacatgctgaggtgtcttgtctgccgggaggtcacgctggcaccatcttgggcagagctaggttggaaaggggctgtttgtcaaagcaaaacagacatatgcttgagctgtgttctgggatgctcttaagttgctcggagacaacttgatccctttgagttttgttttagcatttgctcggtgggaacacagcagattttaatgtaagattaataatattagttgacaatctccaatgcttggcaaggctgtagttggaaacgaggactcatacgctgtcagtaggagtggtagtaacatctatctggacatttatttggcattttctattaagggaaagatgtgcatacccttccagctgtagggaaaagaaagagagatcagactgttactgttgtctatgtagaaaaggaagacataagaaactccattttgacctgtaccctgaacgattgttttgccccgagatgctgttaatctgtaactttgccccaaccttgagctcacagaaacatgtgttgtatggaatcaaggtttaagggatctagggctgtgcagtatgtgccttgttaacaaaatgtttacaggcagtatgcttcgtaaaagtcatcaccattctccattctcgataagccaggggcacaatgcactgcggaaagccgcagggacctctgccctggaaagccgggtattgtccaaggtttctccccatgtgatagcctgagatatggcctcgtggggcgggaaagacctgaccgtcccccagcccaacacccgtgaagggtctgtgctgaggaggaaggcctcttgcagttgagataagaggaaggcctctgtctcctgcctgcccctgggaactaaatgtctcagtataaaactcgattgtacatttgttctcttctgagataagagaaaacccgccgtgtggcgggaggcgagacatgttggtggcagcaatgctgctctgttactctttactccactgagatgtttgggtggagaaaagcataaatctggcctatgtgcacatccaggcatagtaccttcccttgaacttatttgtgacacagattcctttgctcacatgttttcttgttgaccttctccacactatcaccctgttctcctgccacattccccttactgagatagtaaaaatagtaatcaataaatactgagggaactcagagaccggtgccagtgcgggtcctccgtatgctgagcaccagtctcctgggcccactgttctttctctatactttgtctctgtgtcttatttcttttctcagtctctcgtcccacctgacgagaaatacccacaggtgtggatggggctggccctcttcatttggcgcccaacgtggggcctttctctagggtgaaggtgcgctaagaccgtgagcattgaggacagtcgatgagagattcccgagtacgtccacggtgagccttgcggtaagcttgtgcacacggaggaacccagggtaacaatgggacaaactgaaagtaaatatgcctcttatctcagctttattaaaattcttttaagaagaaggggagttagagcttctacagaaaatctaattatgctatttcaaacaatagaacaattctgcccatagtttccagaacagggaactttagatctaaaagactgggaaaaaattggcaaagaattaaaacaagcaagtagggaaggcaaaatcatcccgcttacagtatgcaatgattgggccattattaaagcagctttagaaccgtttcaaacagaagaagatagcgttttggtttctgatgcccctgaaagctgtgtaatagattgtgaagaagaggcggggacagagttcaagaaaggaacggaaagttcacattgtgaaaatgtagcagagtctgtaatggctcggtcaacacaaagtgttgactacaatcaattacaggaggtaatatatcctgaatcaccaaaactgggggaaggaggtccagaaccatcggggccgtcagggctaaaaccacgatggccacctcctcctcagtcgagtgagtgctgggggagggagcctgaaaccaggctggctgcaactcggctcgcggtgcccattattgcccaaccggcagttcactgcggtgaaggagcaattcagactcgccctgtagcatcctgtctgggtcaaacagtggccgctccctaaggaaaagttaggggcgctacataaaatagttaaaaaaactatttaaaaaaggacatgtttcacccactgtctctccttagaattcgccagtgtttgtaattcagaaaaaatccggcagatggcgcatgctaaccgacttaagagccgctaatgccgtaattcaacccatgggggctctccaacgcaggctgccctctccggccgtgatccccaaaggttggcctttaattataattgatctgaaggattgcttttttttttttttttttttttaccattcctctggcaaaacaggattttgaaaaatttgcttttgctataccagccataaataataaagaaccagccaccaggtttcagtggaaagtgttgcctcagggaatgcttaatagtccaactatttgtcagacttttgtagctcaagctcttcaaccagttagagacatgttttcagactgttatatcattcattatgttgatgatattttgtgtgctgcagaaatgagagacaaattaattgactgttacacatttctgcagacagaggttgccaacgcaggactgacaatagcatctgataaaattcaaacaacagctccttttcattatttagaaatgcaggtagaggaaaggaaggttaatcctcaaaagatagatagaaatgagaaaagacacattaaaatatgaaatgactttcaaaaattgctgggagatattaattggattcggccaaccctaggcatccctacttatgccatgtcaaatttgttctctatcttaagaggggatccagaatcaaatagtaaaagaacattaactccagaggcaactaaagaaatacatgaaaagaaatacaaaagcaaataagcacatgaaaagatgctcagcttcactaatttttaaataattttcatttccttctttagctttttattttcttcttcttgaggcagagtctcactctgtcacccaggccagagtgcactggtgcaaccttggctcactgcaacctccgcctcctaggttcaaatgattctcccgtctcagcctcttgagtagctgggattacaggtgtgcaccaccactcccggctaagttttttatttttagtggagacggggtttcatcatgttggccaggctggtctcagactcttgacgtcaaatgatccacccaccttggtctcctaaaatgctgggattacaggcgtgagccaccctgcccggcctccttctttagtttttaaagaaaaattaaaacaatgatttttttttccatctgattggcaaaaatttaaataattcccatcagttcagcaaggatgtgaggctagcgacactgtcataggctgttgatgacggtgtatattggagggcaagttggcagcaatgtaagacaagggtagagaagggagggtccagatggccggggaatctcctctggccagagcagaaagtactggaggaagagaaaggacaggcaggtatgctgagcaccttgtcctgtgttttaattgaggagtttcctggggtctcaccctgtacgctgcagagagcaagtcaggactgtggaacagcctgagctgcagggaacctgaaggaagctttggtaaaacttgatgatatggtttggctgtgtccccacccacatctgatcttgaagtgtggctcccataattcccacgtgccatgggagggacctggtgggaggtaactgaatcatgggggcggatgtttcccgtgctgttctcgtgatagtgaataagtctcatgagatctgacggtttcatgaaggggagttcccctgcacatgctctcttgactgccaccacgtaagatgtgcctttgtgcatcctttgccttccaccatgattgtgagacctcccagccatgtggcactgtgagtccattaaatctccttcctttgtaaattacccagtcttgggtatgtcttcattagcagcatgagaacagactaatacacttggcctttctcccaaacccacgctcagtgtctgtcctgtttggaaagcctttcctggagatacacgctcagatccgaaggacaccatccttccaccccacagccgcattagcacattggctttcatatgtgttcattcaaccaccatttattcagcatctatgaagcagcagacactggggccaggctctagagatgtgcccaattgcagaaactcctggggacactagggacccagctgccgccactcaacacatgctcatcccagactggagagctcatgggctagagagaaacatggaaagagtcagcagaataaaggtgctacatgtttgctggtcaatcctgaggaagtcgtttccttacccttaggttggctttccatgccatgtccctttcttcttgtgtctccttttggtggcctggcatgagggggtggtgtaattgagctagctttcaccactgagacaacaccacaggggaagggcaagaaggcagccagacagaccaaggtctccacagaggtactgcatctggagatcattgtcatatacatgagccggtgctttgctcgaactggctaacatccatattcccatcatcctctcctatctatctgtctcatcggccgacactgcaatgtagaccacatccagaaggcccttctggctccttcttagtggatatgggagactcagagacagagtcctgatgatgttttagagcaggagggttttcaagttactccacacctcgactgtcacctggggatagagtttggatatttgtcccctccacatctcatgttgaaatgtgatccccagtgttggaggtggggcctggtgggaggtgtttgggtcatggaagcagatccctcaagaatggcttgggccatcctcttggtgatgagcgagctctcgctctgagttcacacgagatctggtcatttaatagcatgtggcaactccccacccccttgctcctgccctggccatgtgatggtccaactccacctttgccctctgccatgattggaagcttcctgaggcctcaccagaaacagatgctgctgtgcttcttgtacagcctgcagaaccgtgagcccattcaacctcttttcttatcaatgacccggcctcaggcatttctttatagcagtgcaagaatggcctaatacacctgtaaatttgggagctgcttgcggtcatcctgggaaaaggtgcagaagacatttgtcttcagagaaaaggaagaaaggagcagatccacagggctgaaagacacagggagggaggaagtcctgatggtgtctgagtctctggtttcagtttgttcctgaggcccagctgcagtcctgtcctgggcttctgagagacaaccaccctgcatcccataaacctggtattcactttagaaggtcccatgctttcctgaccttggtggagttgctttctgcttcttttgacccacagaatcccagctgccacatctgcttgatcactgctacagtttggatgttttgtgccctccaaacctcatgttgaaattgatctccaatgtcggaggtggggcctggtgggaggtgtttgctcatgggggtggatccctcatgaagggcttggggttgtcctcatggtggcaagtgagctctccctctcttagttcccagaatatctggttcctaaaaagagcctggcacctccttctctctctcttgcttcctttcttgtcctgtgacctctgcacatgccacctccccttcactttccacaatgagtggaagcagcccgaggccctccccagaagcagagcagatgccaccaccatgctttctgtatagtctgcagaagcctgagccaaataaacctctttcctttatccatgacccagcctcgggtattcctttggagcaacacagatggactaagacactcatccttacagaagaaggtctctgtcttccaatattgggagttaaggaggctccatcagacactctgttccaatctttcgggcaggatgaagagagagggaaaaagtctagactctctgtggttctactttgccagctaagagatctggtaaaatgtgaagagcccaagacaatggcggcagagaggtggtatggtgccccctgacctggcacattccccctcagaaagcgagatcatgacagtggccagccctttccatggtgctgccacatgtaaccagtataaggcaggagtagagactcctgtggacttctcagaaagctggacttccaggggcgctggtggggccagatgtatctccttcctccagctgctgcagaactcaaccttgcttccaacccaggcccctctcagttagtgggtgcaattccccaagacgctgtgttttcataggcagggagccacaggctgcccctgcctttaaattagtcttgcaccctctccatgagagccacagaaagtgaagttcacaaaatgaggatgctccacgtagtggattgaactgtgtcccccaaaagtcatgttgacccaggacccgtcgatgcgaccttatttggaaatagggtctttgcagatgtaatcaagttaagatgaagtccttacagtgggccctaatccaacaggactcatatcttaattaaaaaggggaaaatttggaaacagacacatacagggacaaggtcatatgatgacagagacagagattggagtgatgtgtctaagcatctaaaagccacagaacatcaaggaatgccaccagccacccgaagctaggagagaccaggaacgatttttccctgggagcctctttggagggagcgcggccctgcccataccttgacttcagactagtggatgccagaacctgcaagaaaatccatttttgtcgttttaagccatgcagtttgtgttattttgttctgatggccctaaataaatgaatacagtctgcaagtggatggtgatccagaaactgcttccagcctgtaataagtacagaaattgagtgtatacgcaggcagagtaaatctgttgaatcagagtgtctgttgactctaacaataaagtagatgggcttggacttggtatgtctttttcagttaattgtatgataaattttattgttttaacaaaagtaccagtccatgatagattggaactatgagagagatacagagacagagagagagaggagagagaagagagagaggagagagaaaagagagagcagagagagagaagagagagaagagaggagagagaaaagagagaggagagagagagaggagagagagagagagagaggagagggagagagagagagaggagagacagagagagagaggagagagagagaaattcctcagagatcctggtgaggagctgctgctgtttcctagttagctgatgaactggcttccccttatagtttacatttcatttgcttcatttgtcatttcagcataactctggggagaggacttaaaaatctttgccctctggtcactattttacccagaagttctaatgcttatggttttcttgtattaaagttaaaacatccttatgaattattccgatatggaagtgatgcaatttctacattctgagatgacatcaatgattgtaacatcatttttgtatattcataacagagagagagagagagaaataggatagcaaaaccaaaacccgagggcagcatccacaataaaactaagtggtgacaagatatccacatgaactccaaaatctggagtggctgagaccaaatcacccctcccgcacctgctccaagatctgcagagccttagcatctgagggaagtgagtgggcacctggcagacccagaattccaatacttacctgccttcaggcaattgcaactatggaattctttgtggttgcctccactacaaaacaaggtaataaaaatcatctataaatctgtagctaaccatttcaaaacacaaatggactgtaatgagtaagctcaagtgagacaaaaaaatgatcaaccagattgcttcatcatatctcaacctggtacttgcagagggttctattgagcagagcttagtgttgaggctgtgggtgcagctgtggcttcctcatcccctccaggcaggggtggagcaccatggtgaggggaggggggccagagttcaccgtagaaaccagaagtgctagttaagaagccagaggaattctgagcctcccccctcaccgccttcccctgcaaccagaattgcattcctgcatatttagcaccagaattcctaagcaatttacaagcattagcactgaagttgagaatctgggggagtagggaggggccaataaatagcacctcttccctgcctgccagggttcctaaccaactgagaaattccacaaacgtgccagcagatggggaagcagccttggtggacagggcttgttagaagagccaaatgggcttgctaattcctcacaagccccctagtctagacttagagcggtccactggaggaaggttttgggtctgtagaacaggttcacatccccaatattgctgcctgccaccaaactgggcaggaaggaaaggaaaaagaggccagatctcccacagtgagaacttttgacaaattaaccacttgatccttcctcaaggagactgggggagagaagagttaccgccctaacatgcacacctaatgtttcccaaatttttgtaccttgatatggtttggctgtgtccccacccagatctcatcttgaactgtagctcccataatccccacgggtcgggtcatgggagggacccagggggaggtaatggaatcatgggggcgggtctttcccatggtgttctcacggtagtgaataagtctcacgagatctgatggttttacagagggcagttcccctgcacacgctgtcttgcctgccgccatgtaagacatgcctttgctcatccttcgccttccgccatgattgtgaggcctccccagccacgtggaactgtgagtccattgaacctctctttctttataaactacccagtgttgggtatttcttcatagtgaaacagccaagtagaaaggggccctggagaagctccaaccggctagggcactgggagaacagggtagcgccatggaagtttgtgccatttccaggcgggaggagcctggcccctcctgttcctgtgcggtaacctgggattcaacctgtgagatgggggcctgttaacaggaacccctctggctttgctgagagtctttttcctttttgcccaatatattccataacccctcacccttcaaaatgtctgtgtgccaaatctttcctggtcatgtgacaagaacccagtttttagctgaactgagcagaaagtcctacaacagtagcagtatgaaaatggtcagatacatacctcttaacccattgggcttaactagtaagtctatggtgtacccacagccaaaagtttaccccttactctgtttcctcatcccaaattatttctggccatcgttgcccaacatatctcatcagaggttctgcaacaaggtcaaatggcatctatgagatattctaacaatgagagtccaacatagcacatgtcccaaatgtaaaccctctcccatgaagaattacctgcagagacaataaagttcaaaattctcctgatcagcctggacaacatagggagaccctgtctctacaaaaaaataaaaataaattagccggtgttggggtgatcggactcaacaccaggccgtgggcgtgatgaagtccagcggagtcaaaggaatgagaaaagacagtttgagagagaaagtgagttcagggggccatcgctaagtatggaggctgtgaaggccccgagctctggaagcccagactatttattggtgatcaaagaaacaggtggtgagaatgtggggttgaaagggcgcattgcattaagcacaagatttacagctgtgatggtttaggatatgctctgctacttgagataatggagaacaggttcttttaactcaagatacaatcaatcctgggagagcaaggagcaaggagccagcaagtctagacacattccagagccacgagccctggattctatccaagccacgaggggttttatgccctgggctgagattatggtgcatcagggtagccttctaccctttaccacagagcttggtgttccaaaggccacgaggggttttagaccctggaccccggacatgttccaagacttttacattatgtcagacatgcaagccctgcctcagcttgtctcccaacactcagcttttctcccaacaagctaggtgttcacctgtagtcccagctacttggaaggctgagatgggaggatcgctggagcctgggagggcaaagcagcagtgagctgtgatcgtgccagtgcactctggcctgggcgacagagccagaccctttctcaaaaaaataagataaaataaaattaaatctcccggcaagctgaagctcaaaggcattagaggaaggccgtgccccccacctccgcccccaccccccaaagtcttttgatcttgtgagctatgttggaagaaactgaagtccccaatcactctctccaacctcctctctgctcccactcagctagatgttctcgatggcttgtgggcccagaggtttgcagtctagaccaccatccacaggaatgggtgctgtttattcagtgcctcggcagttgggttatttaaatgccaactcactgtgagtttcccctttaaagagttcataggatgcacaggaatatctagccccggccctatagccaccaaatgtagaagacaagccagtgtcccatcccagtagaattatgttcccagaactcagtcccacgttgccccagaccctatcagaatcagtgatctctaattggtatctaagttgagggaggtgtagaaagtctgggtaattttgagagctgtggtacctgagctatcgctgctttaggatgtctagaaatttgcaaaggcaacagccacagttactgaggtgtcatttgcggtgcctttctttcgaaatgttcggtttctattggaatcttcttccctttccattcctccctcggggccctatgccgaggcaatcctggccggaaagctgcctgccgaaggcgccccaaggtctccctgagcaggcactctcagggcgctccatcgtcccctgcctgccggccaccgccactctagactgccaaccccgcgtccaccaccactgccctttccaggtacaccagtgcatgggccaatgccacctgggcctccaggccatctgtctcccacagtgtccttgggtttctgctgttggctggcttagttcaggaagtctcagcaactctggaacagtcccgcatgcttcccacttgcaaggcaagatccctcatagggcacctcccaaagcctgttccctgggtgctgagaacaatagggtttccacggcctgtgcctccattataagcagaagagctctgctttagcaactgtggctgacgtcagatgggtgcctgagaggaggaagggggaagagcaaggtggaggggctggaaaggcaccaccgtgcggtgttgggagcccctctgggggtggaggcagaggcagaagctactggagtgattcgagggagagtgtgtgattctaagctcagacagagctgtctgggggtcctgtttcctgttttgtggtttcccgtaagaagccgagctggccttccaaggattggaagcttctgaggcctggcagtggcattggcctgtgcactggtatacctggaaagggcagtggtggcagacgcggagttggcagcctagagtggctgcagctggcaggcaggggatgatggagcgtcctgaccggactgggcagcggtgacctccgtcctgctctactgagagggcgaccgtggtgcaggctggacgttgggctgcaccccagtcaggagtcattgggatgtggctacactcgcctggggtgacgatgggattaggtggaaggttaggtcagctgagtggtagcattctcgggttctctgactctgattccccatctcactccctgaagatgactcactcactttgatgactgtggtttcgcagattaaatgtggaggcctgagggccccaaagaatgccctctccgagttattacaaagaagcacagaatcccagcccagtctctgtgtgtgtgtgtgtgtgtgtgtgtgtgtgtgtgtgtgtggtggcggggcaaggggagcagtgtttcaaaggccaccaatctcaggccccattgcccactttacatgtctctctagcaaggcgtggtcacggaattccacccaagccaaccctctaagtttctggcctctggagtcagcctgagacccattcacacgctggtaattgcatagcgggagctgccttttcagcagatctgactgaagcaacattgcccagacctatgccatctctagggttggcacataagacataaacggtcagggtttgggttccgctgggaacctgaggaactgagtgacctggtgaagtcactcccctcggtgggtgagtcccagtacggccggccggtgccttcctggcctctcctgggactttctgagtcccgtgttcgcctctatttaaggcaagttgcagaccttgctgactcctcgaaggacactcccttcctaagagctgccagcaaattcttctgagggctgctccctgtggtccagacaggctggaaagccactgtctgagctccaggaagccactgggccccgccactgttcacctgaggatgggctactctcactgacagcagatggttctcaacggaagagtctcctagacggggctgctctctggatttctgcccctcccaggtcaccccaggcctcctctccaggggtgctcaggggagtgagaaaagccgggcatgccatgctctatgccaggatgtgctctgtgccatgggctgtggtaaaaaagaaatgccagaagccacttcaacagcaaagtactcaaagactgatgaaattatgatttattttagttagattttatttttgtttatgtgtattattactttctgttattagtattaatctataattagttaaattagagcgcattcatattgcggaatgcagcagctacaaagaatgaagtaagccagtaagtgctgactgaaaaccgctcccagacatttcgttaagtaacaaattaaattactgcaataagggtgggaagtttgtagactatgatcccattgaatgtttgcagtgggtgagtgtggtgtttgtgcacatgcacgtgtgtgtatgtgtgtgtgcgtgcgtgtgtgtgaacacgtgtgtgcgcgtgagtgcgtgagtgcgtgagtgcgtgtttgcatgcacagtaccaagcagggaagaaaatgtccctggcagctaagaatggttctctctggagagtggggaaagacggaaggagcaggaaccttcactctgactttcatgtcttacttttcaagcgtctgcatgctgtgtgacttttaccttcctttttgtgtctttcagtgttttcaaggtttagggcccaaaggaaacaaaacacacaccatgtctccgcagcatggtgcagagaaaagagtggacatgatttgacgtggcaaagctatagccaagggcacgagtccaaggaagacacacatgaacccagaaagcaggttcttgcctacccgcagggagggccggccagggacaatggaggggctgggggaggctgggctgggtcgcaggagggggctgggctctcgctggagggaacccctgtctggagggaggccggtcacccttccctctgccagtccttccaccctgggctcctgtgaccatagcgagaggagatgccagaggggaagcccaagctgggctgggctccgtcgggacaggggacctggggcaggagccagtggcgggggcagtagcaggaggtgggtcatccaaggaagaaggcttcctgacccagagctctaaggcgaggagtgggcacatggccctctggggacctgtccagctcaaagactccaggtgcccttcaggtaagtaaaacaaccaagtaatcctcagtgcaacgcgaaagtggctgggaagctggaatcacagtcaccacctatgctgagcaaaaccatgattaaaatgggttttctgctttcgctgaacccactttgtggatcagtggtcctagtagaaatggctcctgcagttgacagctccactggcactgaactctccttgattcttgctttgctgaatttcgagaatcttttaagattgctgggatagagggacgcacggggagaaatagcaggcgaaacaccaggtcctgccaagggaaggaggaaacaaacgcctccccgagggatgccagggaaacagaccagccaagggtgtggtcccacaccaggtgcttgagcccctgttgtcctgagaccattccctccctgactctctcctaactctgtccccgtcactcccactcggcgacctggctcgccctttgccctctgctcttctcactctatgcctgaccctgcactaactgtagaaaatgcagaaatgagaaacagacattcattcaacaagcatttattcttatttatttatttatttatttatttatttatttttatttcttgagagatggggtctggccctgtcgcccaggctgtagtgcagtggtacgaccatagctcactgcagcctccacctcccgggctcaagcgatcctcctgcctcaacctcctcagtagctgggaccacaggcgcatgccaccatgcccggctaacttaaaaaacatgtttttggtagagatggcggtctcactgtgttgtgcaggctggtctcgaactcatggcctcaagcaatccttctgccttagcctcccacagtgctgggattacaagcaaaggctctgaggcagaagtgtgcctggtgtgttccagaaagggctaggggccctgtgtggctgcatcagcgtgagcaagggcaagtgtgggaggtgagaaggccagagaggaaaggctcgatcatgtcgggactgtaggctgccatcagggctctggctttcactgtgagtgagggaagcccactggacagcttagagcagaggactggggccacctgacttgggtttaaaagccgccagctctagccatccagccatggggctagggtggccggctgcacctgggccatgtttgggcagaggtggcgggacggggtcacgggacaatgaaactaaagactcaagctctgggtgaatgaagcccgcacttgtggaccaggttggggagccctatctggaaagagctggtccctgtgcccgttctcctcctccctttcctcctgggactcccttgcaggctcactcctccctatttggattcttatgcacagaagactcattcgctgctttttctaccatcgcagcttttgagggcttttcagcaaggactcaatccctgtcttagtctgtttgcattgctatagaggaatacctgatgctgagaaattcataaagagttttatttggctcatagttctgcagctgtaagatgggtggtgccagcatctgcttctggtgagggcctcagaccacatctacttctggcaggaactggcggaaagctggcatcacatagtgagagaggaaggatgagtcattccacctggaatctggggtgaagtcaactccagcagaatcaaaactgctgaagggaaagggagggagtggttctaggggaaatatgcacactggtacaggggaacagaggttgggtgacaaaaccaacaggtgccctctgctgtggcacagacatttcaacacactcaaaatccacttccaatgttttgaaagaacaggactaggagagatggtttcttattcgagcagactcttcttttataaagtaaaggcgtgtatttccaaagtaatacatgcttgatgaaaatatttcaacatggaagtctgagatttaaaaggtgaaggttttatttccctaaagctattgtccagcgatgagcactcttgagcgtggaggtggctttccagggagttactgtgcacatccctacatgctcacgtggcgggagcacactgccaaaacaagagtgtgccatagcctatatgcagagatctggtgacttgttttaacctctttctatgctagtacccaactatctaccatgctctctctctagcttcctcacactttttcccctggggcagttgtgcagtgatttatttaatttttctgcggctgatgaacatttacattctaaaaactatttacgtggtggtgtcattaagatgctggtggattctacctaacttgcaaatccaggagtttctcagatggattcctcaaggtgggtggaagggtatgcaccctagaggaaaagagaaagttagccccagacaagcagaaggaggacctaataaatcacaaagcagacatcagtgaaacaagtcaaaggctagtaaagaatgctattggccgggcgcggtggctcacgcctgtaatcccagcactttgggaggctgaggcgggtggatcacgaggtcaggagatcgagaccatcctggctaacatggtgaaaccctgtctctactaaaaatacaaaaaaattggccgggcatggtggcaggagcctgtagtcccagctactcaggaggctgaggcaggagaatggcgtgaacctgggaagcggagcttgcagtgagccgagatcgcgccactgcactccagccagggcgacagagcgagactctgtctcaaaaaaaaaaaaaaaaaaagaatgctattaacagctctgtaactataaattcaatgacttcgatgaaatgtataatttcattgaaagacacatattactaaaactgacacaagaaaaaaaggagttttatatcaattacccatataaattcataattaaaaaccttgccacatagaaaactccaggctgggtgctctattggttaatgaatcaaacatttaagaaagaaattctggctccccgaggtggctcatacctgtaatcccggcattttgggaagccaaggtgagagaattgcttgagcccagaagtttgagaccagcctgggcaacatggtgatacctcgtctctactaaaaacagaaaacattagccaggcaatgtatgccgtgcttgtagtcccagctgctcgggaggctgaggtgggaaaatcacctgagcctggggaggtggaggctgcagtgggccttgactgtgccactgcactccagcctgagcaacagaggagatgctgtctcaaaaaaaattttttttaaataaggggatgaagatgtccctcttatggagcagaccgtgtctcaggtactgcagtcagccaaagaacagatcaagtggtcactccttcagtgaagaactcaccgtttctggctcctcacctccttccaaacaatgcacgtctgctgtgaattttcatccggttccccagctgatgctctcagagtcatctcgggaatcacagggatccttaaatctccatcctgtctctggttgccccatcccctccccccctcaaccctccttatacccctcctgttcctttgcttctttggcctcttttttacttgaattattagacttttttttccctacagcgttgtttgagttccttatgtattctggtcattaatcccttatcagatgggtagtttgcaaatagtttgtcccattctgtgtgttgtctcttcactttgtggattgtttcctttgctgtgcagaagctttttaacttgatatgatccccggttaaataatttttgacgagagtgccaatccagcagtctcctcaacaaacagcgctggaacaagtggaattactcatgcaaaagaatgatgttgaacccccatgtaatgcagtaagtaaaaattaacgcaaaatcgatcagcaacctaaatgtaagagctaaaaccataaaactcttcaaagaaaccacagggtgaatctacatgaccttggatttggcaatagcttcttagatatgaaaccaaaagtacatgcagccagagaaaagatagttaaactggacttcatcagaatgaaaaacttttgtgcattcaagaacattatcaagaaagttgttttaatttagttcctttaaaatggagagtactccttcagtgattagaagagccagaagatggaaacaaagaacttctattactcacaggttatggaggctacacggaggtcattcaacatgtgcagagggtgtgtgtggacctggggcacttgcctctatttgggtccagggagatggtcagagcatcgcagtagggggtgagaagattggaggattcaaagcaaatgcccacaaaaaggggctcccaccacgtggacctaatctaactttacatttggtcaggcagctgggtgtgtgtgtgtgtactggtgagatggcttttaggggaaggaaagtggaatcgaagggcagcggttgggaactgggcttaggctattaaccaagggcattgtgtggcatctggggactcatgtgaagacaacaaaatggatgccaggtcagcatggtaatattaagcctcaacacaaaagtgaaaagacaagctgaggaaagtgagaaaatatttgccaatcatatctgataagggtgtagtatccataatatacaacacactcctaaaactcaactcgtaatatacaacacactcctaaaactcaagcaaaatgataaacagttgagttaaagaattgacaaaagacttagacatttctccaaaaaacatacagaaatgaccagtaagcacatgaaatgatgcttaacatccttagtcattagggaaacgcaagtcaaaaccacaatgagataccacttcacagttaagttactaggatggttacttaaaaaatagaaaatagtaagagttgacgaggatggggagaagttggaaccctcatctattcccgactggaatgtaatcgtgcaggcactatggaaaactgtttggcggctgctcaaaaagcacaggtcctcaaacagatacttctgtgccaatgtttgttgcatcattattgacaatagccaaaaggtggaaaccatccaagtgtcatccatgaacggatgaatggataaacaaaatgtggctgtagtgagctaggatttcaccactgcactccaatgtgggtgacagagagagaccctgtctcaaaaaaaaaaaaaaaagtgatcaggctgacgccacctgaacctaaatagcatcacaataaagacaaagaaagatgtggtgcacttcctggtgcaatgtaatgggaaagcacagtcccacctggagagtggtcttggccaaaaagaaaaatgttttctatttctcgaattcattatattttcctagcacaatgtccagttaatcgttttttaaatttactacagtgaatttatcttattgtttttcaaatctctgctatacctatagttatatataatctttccagacttcttttttttttttttttttttttgaggtggagatcaaaaaaggatccagaggagaaggaagccgctcacaccctccggggcaggcatgcggaggtggcattcacctggcttcctgctgggacttcctcacagcgtgcccacgtctcttggaaaaactccgctgctctgagacagaaccggctttggcacggcctggatgtaccaacccccctcgccttcctcagttgtgcagtgatttgttcagcctttccgcagctggtggacatttacattctaaaaactatttacgtggtggtgtcattaagatgctggtggattctacctcatttgcatatccaggagtttctcagatggattcctcaaggtgggtggatgaagggggccagcccctccacacctgtgggtatttctcgtcaggtgggacgagagactgagaaaagaaataagacacaaagtatggagaaagaacagtgggcccaggagacggcactcagcatccggaggacctgcaccagcaccggtctgtgagttccctcagtatttattgattattattttactatctcagtaaggggaatgtagtaggagaacagggtgatagtgcggagacggtcagcaagaaaacatgtgagcaaaggaatctgtgtcacaaataagttcaagggaaggtactatgcctggatgtgcacataggccagatttatgcttttctccacccaaacatctcagtggagtaaagagtaacagaacagcattgctgccaccaacatgtctcgcctcccgccacagggtgggttttctcctatctcagaagagaacaaatgtacaatagagttttataccgagacatttagttcccaggggcaggcaggagacagaggccttcctcttatctcaactgcaagaggctttcctcttttactaatcctcctcagcacagacccttcacgggtgtcaggctgggggacggtcaggtctttctcatcccacgaggccatatctcaggctatcacatggggagaaaccttggacaatatcccgctttccagggcagaggtccctgcggctttccgcagtgcattgtgcccctggtttatcgagaatggagaatggcgatgacttttaccaagcatactgcctgtaagcattttgttaacaaggcacgtcctgcacagccctaggtcccttaaaccttgattctgtacaacacatgtttctgtgagctcaaggttggggcaaagttacagattaacagcatctcggggcaaaacaatcgttcagggtacaggtcaaaatggagtttcttatgtcttccttttctacacagacaacagtaacagtctgatctctctttctcttgcctgcatatcccccttttctttctgacaaaaccaccatcatcatcacggcccgttttcgctggtcactgtctcttcggagctgttggatacacctgtagactaacaacagacagaacagacatacaaggattaatatgaaatttacaatagtggaacttctgatagttttaacccaagtgacggcattaagatttgtgaggccatcagcagctttcacgattgcctcagtttctggcaccagatttaaatgggcttttgatgcctcaaaaatttgttcttttaattttgaaatatctaaagtaagattatcttctcttccttgtagatggcatctaaccatggcccagtgatgctcagactcattgtaggctcggggtgtaatacaaaaatctgacgtattccagtcacactgtaactgaaaaagatatttcaagctcatgagcctatctcgcatccaaatgacagtttgtctaaggtcattaatttggtttgccaatttttgatctatttgggtctgagaattccacaattttgaggaattcttttgccaattatttacatattttaccatttgaacagaggagtgtaaagcaattccagcagccacagcagtagctgtgactgcaacaagacccataatgactgcaattaaagtaaaaatgaatcttttggatctagttagaactccttttaatacttccattaaaatatggacggatggggaagcctcccacggtcggtccatggacacagggatccacacgccctctcttgccctcaccagcagaatatggtgctgccaatcagaagtcgaatcaatgcaagtaaacaatctacaattttcacaggttatagtttgggaatctggtttaataactatttttcctacaactaacatataagggggttttacacaactttgcaaaggaattgtcagattggaatttaggttaatagtataatatggcttacgatctcttgttcctatagcttcatttccagaccaaattctaatgtggtgcgaggccacagtaagcttccataattctgggtgttcaggaccaacaacaggactaactaactttgttcgaagtgatgaaattcccttttcaccccatttccatggatagggtgattctaaccttctgtaaacctggtccagcctttcagttaaatcactatcataggccggattagtgggccagatggatggggcctgtgaacatcagtgagtctggcctgtacaatcataatataattggccttgaggggcccagtctataatagttccaaattcattgttttgtaataccacagcagtatcagccacacattcttcccaaactgagacttctgggccttttgattctttgggaatttccttggggcaaggcttcctcttaggcctaaattttaatgatctttgataagaaggatcctgtaaattatttatctgtggcccgagtgacatttcacttaccatgtgataagtaaatctattgctggcaatgacagtaggtacttctaccaaccaattttgggttgtaggaattaaatatcctggtgccttccctaggcaaataggaggataatgatacccaatggaaatatttatcatcattccttctttttcaggttgggcagggcaacaatcatctgtggggcctggtactcatgcactattattaacacatactttaataggattatctatccatgtgactgcccgaattaagggcgggaaaggcacataggtccagtaagtataattagctgcagctgctcctgcagacatggggacacttaccaccattgatacaatcatcaaaactgcaagcagcatattctctggagtttgtgttacccttgttttcttcaggcttttttcagctaactgtgtcaacttctttagttgggcccaggtcggcggctccacttccttggtggatgtcaacttcatctgttcttctgataccaccattttgttcacctggcgagtcgatgatgctcgattgcgggttttctgtctccgcggaggcgcttttctttgcatttccgatgggttcattgtagaactttaaatgtctagtgggtatccaaacaggaagctgacttttttcctggtgaaacgcaagcaaagcctttcccccaggttatcaccttccctatttcccatgtcttatttttgatgtctttccaccaaatcagttttccttcatgtgggctgttctttttaccagtaaaatgttgttctgcagaagtagtggtctgatttctataaacgtttaaaaattttaaagtatagagtgctagattgagttgcatctgaggagtgttatactccttactatctttttcctttttttgtttaaccaattgagctttattagttctttcaattatggcctgtccttgggaattataggggattcctgttgtatgtgtaattttccactgatttaggaatttttgaaatgctttactacagtatcctggcccattatctgttttaattttttctggaactcccatgacagcaaaacaagataataaatgtcttttaacatgggaagtactttctcctgtctggcaggttgcccatatgaaatgtgaataagtatcaactgtcttcatggacaaatgacatttttccaaatgaaggtacatgtgtgacatccatttgccataatgcattaggacataaacctctgggattaactcctgcctcctgagtgggccagtgtaagacttgacactaggtgcaatgctgtacaatattttttgcctgtttccatgtgatatcaaatttattttttagtcctgttgcatttacatgagtcaaggcatgaagttcttgtgcttctatgaatgcagatgatactagcaagtcagcttgttcatttgccttagttaaaggccctggtaaattagtatgtgcttgaacatgagtaatataaaatgggaaatttctttttcttacagtttgttgtaacaaattaaacagctggtgtaaccgatcatccatactgtatttgactagggctgtctcaacatcctttgtagcctgtactacatatgcagaatctgatacaaggttaataagctgattaaaatcttgtaacactgaaatgacagcaaccaactctgctctttgagctgagtgatattgagtttcagtgactcgtttttttggcctggtgtaagccacctttccattgctggaaccatcagtaaacactgtcagagcattttctaaaggtgtatgtctggtaattttaggtaaaatccaagtagtcaattttaaaaactggaaggtttttgtttttgggtaatgattgtcaataattcccacaaaatcagcaagaccaatctgcaatgcaccagaattgataaaggcttgtgtaacctgttccttgtttaaaggaacaatgattttatctgggtcacttccacacaattttactattcgtagtcttgcctgaccaattaatgtagccatttgatccaagtacaatgtaaaagtcttaatcgtactgtgaggaaggaaggaccactccacaagatctgtattttgaacaatgatgcctgttggagaatgtgcagtagcaaaaatcaaaagttggagtggggctaagtgatctattctatttacttgtgctgaccgaattttgtcttcaactaattcaatttctttagttgcctctggagttaatgttcttttactatttgattctggatcccctcttaagatagagaacaaatttgacatggcataagtagggatgcctagggttgaccgaatccaattaatatctcccagcaatttttgaaagtcatttcatattttaatgtgtcttttctcatttctatctatcttttgaggattaaccttcctttcctctacctgcatttctaaataatgaaaaggagctgttgtttgaattttatcagatgctattgtcagtcctgcgttggcaacctctgtctgcagaaatgtgtaacagtcaattaatttgtctctcatttctgcagcacacaaaatatcatcaacataatgaatgatataacagtctgaaaacatgtctctaactggttgaagagcttgagctacaaaagtctgacaaatagttggactattaagcattccctgaggcaacactttccactgaaacctggtggctggttctttattatttatggctggtatagcaaaagcaaatttttcaaaatcctgttttgccagaggaatggtaaaaaaaaaaaaaaaaaaaaaagcaatccttcagatcaattataattaaaggccaacctttggggatcacggccggagagggcagcctgcgttggagagcccccatgggttgaattacggcattagcggctcttaagtcggttagcatgcgccatctgccggattttttctgaattacaaacactggcgaattctaaggagagacagtgggtgaaacatgtccttttttaaatagtttttttaactattttatgtagcgcccctaacttttccttagggagcggccactgtttgacccagacaggatgctacagggcgagtctgaattgctccttcaccgcagtgaactgccggttgggcaataatgggcaccgcgagccgagttgcagccagcctggtttcaggctccctcccccagcactcactcgactgaggaggaggtggccatcgtggttttagccctgacggccccgatggttctggacctccttcccccagttttggtgattcaggatatattacctcctgtaattgattgtagtcaacactttgtgttgaccgagccattacagactctgctacattttcacaatgtgaactttccgttcctttcttgaactctgtccccgcctcttcttcacaatctattacacagctttcaggggcatcagaaaccaaaacgctatcttcttctgtttgaaacggttctaaagctgctttaataatggcccaatcattgcatactgtaagcgggatgattttgccttccctacttgcttgttttaattctttgccaattttttcccagtcttttagatctaaagttccctgttctggaaactatgggcagaattgttctattgtttgaaatagcataattagattttctgtagaagctctaactccccttcttcttaaaagaattttaataaagctgagataagaggcatatttactttcagtttgtcccattgttaccctgggttcctccgtgtgcacaagcttaccgcaaggctcaccgtggacgtactcgggaatctctcatcgactgtcctcaatgctcacggtcttagcgcaccttcaccctagagaaaggccccacgttgggcgccaaatgaagagggccagccccatccacacctgtgggtatttctcgtcaggtgggacgagagactgagaaaagaaataagacacagagacaaagtatagagaaagaacagtgggcccaggagactggtgctcagcatacggaggacccgcactggcaccggtctctgagttccctcagtatttattgattactatttttactatctcagtaaggggaatgtggcaggagaacagggtgatagtgtggagaaggtcaacaagaaaacatgtgagcaaaggaatctgtgtcacaaataagttcaagggaaggtactatgcctggatgtgcacataggccagatttatgcttttctccacccaaacatctcagtggagtaaagagtaacagagcagcattgctgccaccaacatgtctcgcctcccgccacacggcgggttttctcttatctcagaagagaacaaatgtacaatcgagttttatactgagacatttagttcccaggggcaggcaggagacagaggccttcctcttatctcaactgcaagaggccttcctcctcagcacagacccttcacgggtgttgggctgggggacggtcaggtctttcccgccccacgaggccatatctcaggctatcacatggggagaaaccttggacaatacccggctttccagggcagaggtccctgcggctttccgcagtgcattgtgcccctggcttatcgagaatggagaatggtgatgacttttacgaagcatactgcctgtaaacattttgttaacaaggcacatactgcacagccctagatcccttaaaccttgattccatacaacacatgtttctgtgagctcaaggttggggcaaagttacagattaacagcatctcggggcaaaacaatcgttcagggtacaggtcaaaatggagtttcttatgtcttccttttctacatagacaacagtaacagtctgatctctctttcttttccctacagctggaagggtatgcacatctttcccttaatagaaaatgccaaataaatgtccagatagatgttactaccactcctactgacagcgtatgagtcctcgtttccaactacagccttgccaagcattggagattgtcaactaatattattaatcttacattaaaatctgctgtgttcccaccgagcaaatgctaaaacaaaactcaaagggatcaagttgtctccgagcaacttaagagcatcccagaacacagctcaagcatatgtctgttttgctttgacaaacagcccctttccaacctagctctgcccaagatggtgccagcgtgacctcccggcagacaagacacctcagcatgtcatgcagaccccacagctgcctgctccctcccctgcctaccattcacgccaagtcctcctttaaaaggccctgctttctgcccccagtgggaagcagcacccttaaaggcaggagcctgtacgtcttcccctaaatcaagcatggcagaaagtccgtttctttatagcagaccacgctcttgttaattggatctccaagcgatgagggaatgaacctgtgttttggttatattacatgttcacaaagattttagattatttgaattactattatcattattttagaggcagggtctcactctgtcacccaggctggagctcaggggtgcattcatagctcactgcagcatccagctcctggactcaacacatccttccacctcacacctcagcctcctgagtaactgggactacaggtgcctgccaccacacccacctaatttaaagaaaaattttttttttgacagagtctttttctgtcaacctggctggagtgcagtggcatgatctcggctccctgcaccctccacctcctgggttcaagtgattctcctacctcaacctcccaagtagctgggatcacaggcacacaccaccacaccctgctaattttttcttttcttttctttctttcttttttttttttttgagacagagtcttgttctgttgcccaggctggggtgcagtggcaccatctcggctcactgcaacctccaccttccaggttcacgtgattctcctgcctcagcctcccaagtagctgggatcacaggcgcacaccaccacgcctggctaatgtttttttgttgttgttttttttgtgtgtgtatttttagtagagatggagtttcactatgttggccaggctggtctccaactcctgacctcaggtgatccgcccgcctcggcctcccaaagtgctgggattacaggcatgagccaccgcacccggccttttaatgatttttctacagacagaatctcgctacattgcccagggtggcctccaactgcaggtctcaagccatcctcccgcttcaagcctcccacagcgctggaaatacaggtgtgggccaccatgcccaacccatatcacatgcttaacagtgatatgataatgctggttctatgcatctattcaagtacgttttcaaagaatttttcccaagtaaaaaagctcatatgttcaatgaaaacaatttgggaaaaaatttaatgctgacctggaaaaacattatatatgctactgtcatatatttaacatataaatgcaagtatattgaggaaaatattctaaaatgtccacagtagttaatgctgaatggcgggacccagtggcttttcattttcccccatttcccaaattgcctcccgttaccttgtgctacttcaatctgtgaatcccagagcctcccctgcaacccgaggacaagggcatgcaagtccgaaggtgccttcgctcgccgaaaagagactcagacacggaatcgtagctcagttttattttctacagaaacaaacatgtaagccgtcctcctccagcgacaaacaatcaggcccccacaatgaactggccactcgtgctgggaccattccctaggggaggaggcatgacctaggaaggggcgccaggctgggcttagcgcctctgccctgagggaggctgagccaaaaacacgggcagaaagcactgcgtgatccacatcaacagggaaagctgctggagacaggagctgatggagagctgcagttggcggtggtctgcagcagtcagtcggctaaatgtgaggggcagagaacatcacgttaaaggcgacacctctgcacccatctccctgggctccctcgggtggcggcgggcctggtgtaccaggtctctgttctgagaccctgtgctggggtgttcccaggtttctagcagcctgaccgtggggtgtaggcggatcccagcccccaccctgccacgctgtgaccgccacccacccaggccccatccctgtcctggtcctgaactgacatagtcagtatgttgccggacacagtgaactccttcagaagcacccctggcacgggaagcggtggggcatcctgggccaggctcctgcgggccagctctgcttccatgggtgtcgcgaaaggcatggcgaggtagctggtgggggcccagttaaggcatcctctcctaggacttggcctgtggctccggcctgctgcttaccccaggccagcttccccctcccccactcccccacccctcccccctaccccggattgcccagcccatcccccccaggctgtctccccaggcactggcccagtagcacaccccacccagctgtcttggttccccactttcctttgctgcaccccaagctgactcctccatgcccttacaagacccctccccaccctgccccctgtggcatcacccggccccctcctcatcactcgaccctccatcccaaccacctcccgccacccgctcccatcttgcccccttccccccacctcctgatcccctcctacacctgggtccccctatctcctggcccctgctcccctccccgcatgacccggtgcccctcacccaatcacccagcccctctcccccacccccaccccctctacctcccagcccttacctcctcccctcctcgcagctggcctctcatatccccacctcccaacccccacccccacccccacccaaccacttactcgcatctcccccgcctcctcccccacctggccctgccctccccatctcccggcccccacctcgccaccagaactgtcagaacagaacagaacagaacagaatacaactcaagcaggcggctctccggccccctggccccgcatctgcagcatccattcagccctgaagccgcgccgccatgcggaccccgcggggcgcctcctcccggccccgaggcccttgctgcccctgcgccccggggacctctgccgcccgtggcacccgcctctcctgggccgccagcattgccccctgggccatcaggaatgccagggcctcctgggccatcagcatcgcccgtcgaaccccctgtgccccggccttcggcctgcatggctccggagcctctgcccggctctcagagagaaggtcagggcccacgaggatgcggaggcagagaggctgcaggaagttccgccccctggcgtgagatgggcagcccgggatcctcagggcgcctgcgcacaggggccctacttccggccctgggagaccccgagtgagccccggagcacgtgaccggttctcaccaaccccgcccctccccaagagagcccgggccggaaggtggccgcaatgccagcttggacccctcacccctgagcagccggctgtccgccggacccctgtcccgggagccctgcagggagtcaggcactgcggggcccagcctgtcccatcccccgggtctccctcacatcgaggagcaagacgggcctgggaacacggggccgggactgtgcggccatcgtcccggaccctgcctgccctgtccgtccttgggggagcgcccaggacagaccccggggggcaggcctctaactgggctcagcagcctccgtccctgtcctggtcgcccagctggtggggtagctggaactgcatgtctggtgggcgtggcctcgcgccagccaaggtctcccaggcgccaggtccagccaaggtggacgggagggcccagcgggacccggggccggatctcactcctgggttcaacgggttctgtccctgtcctagtcgccccgcctggtgggggagctggagctgcgtgtggggtgggttgcgggtggcctcccaccagccaggggctcccgggctctaggcctggcccaggtggacaggcgggacctgctggacctgaggctgggtcgggcctggctcctgggttcggcagtatcagtccctgccctggtcgctcttgcctggtagggagctgggaggtgaccctgtgtctgctcagtggtgatctatttgtgtgtctggaagggggtcaaatccacgggacaggtacctctagaggcatgcaggggtgagggcggcacggccccgggagctgaatgtctgtgccaggcacacctgtagcaacaggaggtgaccagacagggcctagccctgaggaagggggaggtactgaaatccaaaccactctcccccaccttccaaatccaggaatcagcagcctctgcacctgggaaaagcatattggcactcatgtggaaactaaaaacgttgatcttttggaggtagagcagaatgatggttaccagacgctgggaaaggtggggagggtggggaggttaatggggacaaacatatagttgcatagaaggattaagttctagtgtttgatagcaccgtagagggactataggtaattatttattgtatatttcaaaatagctaaaagataggaaatgttccccaaaaaaagaaatgataaatgcttgaggtggtggagatcctaaataccccgacttgatcattacatcgtgtgtgcgtgtgcatgtatcagaatatcacatgtatcccataaatatgcagagttatcatacatcagttaaaaatgtttttacttacagaaaagaaaaattcacccaagctcttgcgtgtacctccagtttattattttcactgctgtatttcattacatatatttcattaaatgatgaattttaaaaaccagagaacacaacttgttaacacctggaatagctgaaaatcagacataacccggttagtgattgccatccttcctgtcgtcctctgctcagtctccccattctcagacagaggcaggctaaagttcttaccttcaacaggtcagggaagggagagtaaagtgcatgtgaccctgtcttaggaagcaggaagacagagggagggtctccgggtccccattattttcccggcctattatcctcagatcaagtcaagaaaggaagtcctaactgattgagagattcctggagatactgccactgtcctggaagtctcagccagccactggaccggaaatctccatcaatatttcagccagagcaacgtctgccactagatggcatcaaactccagccgggagcaggacagatttggatggtccagcgggcttgcctcattcatttcattaaccccacagtaacacattttcacattgtatgtgattggatttcttggaaactacctattacattacggcagagttttatagtcctctaatttatccattctgctgatgatgggcaggcatttggatagtttccagcccttggctatgaacatgcttgtacaggtctcttgaagcacatgtccaagtttttttttggaattgctgtatcacagccaatacatatctcgaaatttactagataatgccatgttttcccaagtggtttgagccaattttcgcttccaccataatgtgtcagcgtacatacacatagctcaacattctcatcaatattgacggtactaatccgttctcgcattgctataaaggactacctaagactgagtaatttataaagaaaagaggtttaattgactcacagttctgcaggctctacaggaagcatggctggggaggcctcaggaaagttacaatcatagcggaaggcaaagaggaaggaggcacatcttatatggccagagaaggagaaagagaaagtgaagggggaggtgctatacacttttaaacaaccacatcttgtgagagctcaacatcacgagaatagcaagggggaaatcgacccccatgatccaatcgcctcccaccagtcccctcctccaacactagggattacaattcaacatgagatttgggtggggacacaaatccaaatcatatcattccacccctgccccctcccaaatctcatgtacttctcacattgcaaaatacaataatctcctctcaacagtcccccaagtcttaacccatttcagcattaactcaaaaatccacagtccaaagtctcaactgagacaaggcaagtcccttctgcctatgagcctgtaaaatctaaaacaagttagctacttccaagataaaattgaggtacaggcattgggtaaatactccctttccaaaagggggacatcggccaaaacaaaggggctacaggccccatgcaagtccaaaacccaacaggacagtcattaattcttttttttttttttttccactacaaaataatttattcgaacacacagctacagcgcgagactcctatgtacaagcacattgacgctcctgactaccctcaactagaggacccttttcttcccccttgccttgcagacctcttctatcgaatctttcatgtactggatctcctcggccagggaatccgccctctcttgcagagcctcgttcttcttttccaccgctttgcactcaccagtgaggacctcctgctccaccctcttcttctggcgatacctagttcctgctgtttggttttgctccatttttttttcagcttcttatccagtttctcaccctttacttgtgctgctaccatcttctctccaggagggtcataaggtttggggcaggcagagccacagaggacacctggagatggcgggctcctactcggagagcccctggaggtagagggagagcccagataggactctgggctcatacagatgccactatcattatctgagggggcgtcttcctcctttgtgcagtgagggatcttggaaatgtaagcagtggagtctggcttcctagctccttcaaagatatccacttcactgcccagctctagactaaaggaataatctggagtggaggactggacccctggggaaaggggaagaggttgcaagaaggtgaagggggcaacctggtcgggttaaactttctgggagatggcaaatcgggttcaccatctggggggggctccttaatagtctcctggactgggggggctccttaatagtctcctggactaggggggcaaagagatcacacgagtcatccaacgtggccagaagctcgtctggcatggtttccaggtcatctatacccaacagggcatcaaagtcgaactccttcagatcagttttctccaacatccaatctgtcccaaagaaagcatcctccttgccatcgttggaggcactgaccaacccatccacagccagccactcggaggagtctgccttagccttgtcgctggagaacccatgaggtttgaagtgcttggccacctccaggtagtcatctaagagacctaggctttcttcagtccccaaacctgactggtcaaggggggacatcaagcccccaccaacacctcgctgctcaggaagctcatctcggtcatggtgcagtgctttgctggaatcaacgaatgtgcttaattcgaaggtgtctttgtcggttacagcaatgctgctgctgaatgctgtgagaagtgctacggcttaagccgccggtggatgccactgcagagcctggtgctgctgccaccgctgcaaaggccaaggctgccacaggcactgctgcccctaaaacgccatggaggccatggaccctgcaggcggggaggagggaaggtgcgcacgtgcggaggaaactacatctgtgggcgggcggagcagaaaatcgtcattaattcttaaagctccaaaataatctcctttggctccatgtcttacatccaggccacactgaggcaaggggtgggctcctgaggccttgggcagctccgctcctgtggctctgcagggtacagccccctcggctgctttcctgggctggtattgaatgtctgcagcttttccaggagtataatgcgagttgtcagtggatctatgattcgggggtcttgaggatggtggcccccttctcacagctccactaggcagtgccccagtggggactccaaccccagatttcccttctgcactacgctagtagaggttccccaggagggctccgcccctgcagcagacttctgcctggacattcaggcgtttccatacatcctctgaatctaggcagaggttcccaagcctcaacttttgccctctgcatacccgcaggcttaacaccacatggaagccaccaaggcttacagcttgcaccctccagagcagcagccggaggcgtatctggggcccttgtagccatggctggagctggagcagctggggcgcagatagcagtgtcccgagggtgctcaggccagcagggctctgggctgggtccaaaaaaccattcttccctcttcagcctccaggcctgtgaatgaccctcaaaaaattaaaaatagaactaccatatgatccagctctcccacttctgggtatagatctgaaggaaatgaaatctatttcttcctgagtcagttttcatggtttgtacatttctaggaatttgtccacttcatctaggttatctaatttgttggcaaacaattgttcacaatcttctcatgtaatcctttttgggggtagaagaattcagtaacaatcaacaaaatgaaaaggcaacctgcagaatattgaggaataacatattgttcacatcttatcaatataataaaatatgtgcattttgtgggggcaataataaatactctcagttttttcctcatcagctataacagggttggagtctacagtgatatcttctcaagtctccagcatctgtgtcgcactcaggtagcaccacacagtcccgagtgagcccctaacagatactcatctcccttgggacagaagcagcacatagacttccatctctggtcattaggtcccacggcctagggaccatgtctcaaaattagcttcgatgccataacatatttgatcagaatataggtaatgtgataagctgaaatataagcattccaactgaacttcaggcatagcaatggcaaattggaaagagatgcaaagagatttcaaggaccttggaaattcacgatgtcatttaagaagaaaacacacgtcactccattccagtaaagaatcacagactcggccatgcatgttggctcatgcctgtagtcccagtactttgggagatccaggtgggaggatcgcttgagcccaggagttcaagaatcacagactcttccagctcccagtccggtgctcttaaccactacgtgctgccagtcatcaatattctcccatatttcctttaatgaaataggatcattaaagcttagggggaaacatttgacaggaaaagatttcacgtatttttctagattttcatttcttctttttgttgttgttttttttggagacaaggtctcactctgtcacccaggtcagagtgcagcggtgcaatcacagctcactgcagcctcgacttcccatgctcaatccatcttcccacctcagcctcctaagtagctgggactacaggtgcacacctccacgcccgactcattttttaaaattgtttgtagagatggcgtctgactatgttgcccgggctggtctcaaactcctggacacaagcagtcctcccgcctcagcttcccaaagtgtagggattacaggcgtgagccacactgcaccaggccgccttcatttcctcttttatatagactccagttgaatttttaaaaagtagttggtcgcccggaggcagagactgtcttatagtttttctgtttcccagagtgccttgctaaatacccaattgttgacctaatctttaaactcagaagtacaaatttactgcactgtaaagacatagactcaacaggtacaaaatctttggtctttcaatcaacataggtcatggaaacatcacttcattcctaaatgccaacgtaatgaatacaagagaattggtttgaaacaaacattttgatcagtgttcacttaaattcccaggggattcccaccttattccactccctcggctcagcacacgtattataagccacactagtccgcatctggtgttacaactttctgtccaatttcagaacaccctcctttcaccaattcatgacctgcaacccttccaccgccatttccacaagcaaacttcaggtctttttcaaggtgaagtgccgtacttgctgcagcacttaggtattttttaaccatttaacatgcatagaattgtgctaccattttcattaggttcctatcttcgtttttttatgtgtcactgacaaaggttttgagtattgtgtccctaaccccatttttcctataagttttgcgatttgtactacacaatgattttgaggtgtacacgtatgtcatgctataatcataactcattgtatcacggtttggggaaaaaattaaccaataaccaatttattttttcaaagataacaggtgtgcaagcttccagcaaatctgcttaagcataagatcaaatcagagaacagctgtttttcctccaatgttgatccagtggctagctagccctcaaatcagacactagatttggaactgggaggacatcattcaccttgaagtagtgaacaaaaacatggttttgtcaaaaaataaaagggataaaagtcattataaaaactgtctttcccaccaggcatggtggctcatgcctgtggtcccagctactcgggaggctgaggtgggaggatcacttgagcccaggaggtcgaggctccagtgagctgtgattgcactactgcactcctgccagcctgggcgacagagcgagaccttgactctaaaaaaagggaaattatcttttccatcctcagagcaagcatgcagaatattattgtcatcctattcatagacgtggaagctaaaactaagagaggctgagtgactggcccaaagtaccatggctgataggggttgtaatgaactcaagtggtctttgtctaggatcagaaataccaccatcatatgtaatggtgcttgtaactgtgacgtgttatttccaattgtctgcaaaacacaaacatgaataaatgagatgagttgttggggaaaagtaagaaaaaggtgacactgttaaggttacccatctctccacgtacctcgtaacatcagaccctgattggggcagaaaaccctggcctgtaccacgataaatgcctcctgtgcaataataggatgttcaacagctcttcggtaccaacgatgaacaaattttttgcaaaagaatattattgctgcaattggccgggcatggtggcttatgcctgtaatcccaacactctgggagaccgagctgggcagattgcttgagcccaagagtttgagagcagcctgggcaacatggctgtacccactctctacaaaaaattgtaaaatttgccaggcgcggtggcgcacgcctgtggtcccagctactctggaggctgacgtgggaagatggcattgagcccaggaagtcaaggctgcaataagccatgttcatgccactgcactccagcttgggtgacaaagtgagacctggtctctctctatatatctgtctatctatatctatatctatatctatctatcatctatatctatatctatagcttagctatatctgcaacagtgaatagaaacccctttagcaaagtgttcccaaactcttgcttctaattcttgaccaactcagaagtaaaggaggagaatgaagtaaaggaagtcatacgtttccgtgctctcatgcatatttttatttctgtaaggtcagtagtaatgtggctactttcatttctgattttagtcctcgctctctctgtcttagtccagctaaatgtgtctccgttgctctttaagcacttccttatttttctgggacaacaagatgatccagttaatcttggactttctctgccctagccctggaatcagtcatttctctagtgagctctgttctttttaatcaagacggttgtttagaaatcgagacccaggcactaagtcaactcactgctattgagatggtcccaggccttctaagtgatggagctgagaaatacccatacacacagccctattttacagctatgcttatttctatacctatctgtatattgaaagccatcagtgtatcaggccactcttgcaccgctataaagaaatacctgagactgggtaatttatacagaaaagaggtttaatgggctcttggttctgcaggctctgcaggacgcctagtgctggcatctgcccagcttctagagaggcctcgggaagcttctacttgtggtgggaggcaaagcaagagcttgtgtatctcatggcgaaagcaggagcaagcgagagagagagagagagagagagagagagagtgtgtgtgtcggggcggggggaatgccacccactttaaaatgacaagatctctcgagaactcactatcacgaagacagcaccaagccattcatgagggatccacccccatgacccaaacaccccctaccaggccccacctccagccctggggattacaagttaacatcagatgtgggtggggacaaacatccaaactagatcaatgaattcacaccaacaactccaaatcgaatccacattcaagccttctctcttttcatatctgcaactccttttccaaacggtgagaaagccaggtccctacatcattcatatatttactgcaaagccagtcaaccatctgagcccatcaggtcaccacccaacttggcacacgttcctctcttggacccctgacccctccccaggacacagtcaccctcgccgactcccttccttactccacaaaacttccttgtgcaggacactgctgcgctcagcggaggatcgtgcttcacactggtccccagctgccctccacgctttccttgagtgggcccccaatcccaggggcttttggaagaagagggggagaaggacaggaccgaggaagagaggcaggaaggaagaccagcagagcagccggcaggaagagccattattccttctgatgctccattcgtagccaatggcaactcaaattggttggcagcagtgtcctcctgacaaacgctgtggtcatgtctcagatttacctccagagggagcacttcagtccatagtcttggtgccagctgcaatggcattagcattgctttgaaggcttttcaggggacagagaaagcaaatgggtattttttagaaagagaaaaataaattgagttcatcacgcctgtaatcccagcactttggcaggccaaggtgggaggatggcttgagcccaggagttcgagagcagcctggacaacatagcgaaaccccatctccacgaaaaaataaaaaattagccgggcgtgatggcacgcgcctgtagtcccggctactcgggaggctgaggcgggaggatcgcttgagcccgggaggttgaggctgcaatgagctgtgatcgtgccactacactccagcctgggtgacagagtgagaccctgtctcaaataaataaacaaacaaacaaagaaataaaaagttagacagcttttactttttggatatatatattccctattccctgtggatattcacaagcctttttttttttttttaagtttttaaagttcagttgttctgtcatctgtgtggtgctccagcatctgttttgagtctctctctgtcacccaggctggagtgcaatggtgccatctcggctcactgcaacctccacctcccaggttcaagtgattctcctgcctcagcctcccgagtagctgggagtacaggcgcccactaccacgcccggctaatttttgtatttttagtagagacggggtttcaccatattggccaggctggtctagaactcctgaccttgtgatctgcccacctcggcctcccaaagtgctgggattacaggtgtgagtcactgcacccagcctccagcatctgaactcttagtctcatggtctctttcctgccctgggtgtgcttagtttttatgtgcactgctcagtgtcattaagaactttttttcccccagtgctcctaaagttgttatattaatacatcgctctttttattttaagagctcaggtgtacatgtgcaggtttgttatatgagtaaacttgtgtcatgggggtttgctgtacagattattttatcacctaggtattaagcctagcacccatgagctatttttcctcatactctccctcctcccaacctccgccctgcaaaaggccccagtgtgtttcattcccctctatgtatccgtgtgttctcatcatttagctcccacttataagtgagaacatgtggtatttggttgtctgttcctgcgtcagtttgctaaggataatggcctccagctccatccacgctcctgcaaaggacatgctctcactcaggaacttttgtggagactgcatctcaaccccaggctcccacgaatccacacatccgttggggtaaccgttgtgggttgaattgtgtcccccaaaaaggtatgttcaagtcctaacacctgggtgcctgggaatgtgacctgatttggaaatagggtctttgccgatgtaatcaagttaaggtcatactagattggggtgggcgctaatcaaatgtgactagtgtcctcataagagagagaggcagacacactgggaagatgaccccacgaagaaggaggcagagattggagcggtgtctctatgagacagagagtgccagggattgccagaaaccacctggagctacgagagaggcatggaacagattctcccacagagcctccagtaggaaccaaccctgctgacagctggattccagacttgtagcttccagaaccacgggagaatccgtttctgttgttttcggccacccagtttgtggccatttcttacggcagccctagaaaactaatatgggtactgtcggcccaggaccacctcagaccaaatttaggactcgagggccactgaacggccccaccaggaaaacctagactgcaagtctgcacagaacctggcccttggccacaactttgcacaggggtgttttccctttcctttcatctcctgcttccccgcaatctgcagagctggggtggggtttccttaacgtagcgggggctgctatacaactccccacacttcacaaaggctttgggccttgcctgctgtctcccttgcctggacggcctccagaaccaaaacccaagtttgcccaggtcggccagcgtcctcgggaaataagcagcttcagtggcgtacttcttcttggattcccacttcctctcaggttttgctctcttgttggttctcagctgttttgaacagtctcaaactgtttcatctatcatttgcagttattttcagcagaaatatctgtctcaataataccacccagcatcaccagaaacagatggcaggtcttgcagtgctttcggggatggacagacagaccaccctgaccaccgcccgctaggtgcgggagaagacttatttccagctatagcacacatttgtcgactttggctctcctagactgagaaagcaaatctcaccccttcccctcaggcctgcgacactcggaaccaacgcgaccgatggaatccctggatctccccgcttcctgtgaccgctgagttctgttcctccaagggtacaatgacatccatcagctgcctgccccctgctgacacactttctgtttgagggtttccctctcaatgactatagagaaagcaacctgggccgggtagaagagcagctgctagtctcctggttggtaccaaccctgggtctctgaggaaaggacagagtagggtcactctgcttcacaacacaaagtcagtcgcccattctccctgccagttctcaagcctgtaatcccagcatttggggaggcccaggtgggaggatcacttgatttccaggagttcgagtccagcctgggcaacacagtgagaacctgtctctactgttaaaaaacgtaaggaaggaaggaaggaaggaaggaagggagggagggagggagggaggaagggaggaaaggaaggaataaggaaaaaaggaaggagggaaggaaggaagggaggaaggaacgaagaaaggaataaggaagagggaaagaaggaaggaaggaataaggaagagggaaagaaggaaggaaggaataaggaagagggaaagaaggaaggaaggaataaggaagagggaaagaaggaaggaaggaataaggaagagggagtgaagtaaggaaggaaggaataaggaagaggaaggaaggaaggaaggatgaaaaaaaggtcacctgtcaaacatagctttaggagaggatgtaaatgttcaatgttgatcttcttctgtgtcttcatttgcattttcatgggagcttacaggaggcgcccaggtgtcttagacaacatttttaaaataacgacttgaggtttaattcacatgctacacaattcacatgtctaaagtgtacaattcgatggtttttagtatattcatagatacgtgcaaccatcagcatgaccagcttcaggacattctcatcatctcaaaaggaaactctgtctccatcagcagtcactccccgttttcccccaactcctccagccctgggcaacaaccaatcgactttccttagacaacgttttgagcccttattgggaggaattatagtcgaatggaaaatccagtttgggacgtggtgtaaactggaattgctttcgtggtttttccttgtgccttgggtggggcactgccgtaagagcattgcatccatcctttcgtcggtactctgctgcacacggatggcatttctgcccttgttacagatgaggaaactgaggctcagagacattaagcaaggggcagagtggggcttgtccatgagaccccagagtctgtgctcttgcacatacattatcaggccaacatgatctatccatccgaattccaaataaataaataaaaatgcttataagaagtccccccatgctgcggggaggcagcggctcatgcctgtaatcccaacacttagggaggcacaggtgggaggattgcttgaacccaggagtttgagaccagcccaggcaacatgacaatacctgcatctctgcaaaaacgaaaaaaaaaaaaaaaaaaaaaaagacaaaaagaagtccctccaagttagtcgccatgctctctaccatgggttttctgtgttatccctatcacatgcatacagtcatttctaccaagcaccatttatggtgacagggtatggtctacaaaaatattgacagagaaatcctgatggagctcaagacaagctcaggccaccaagaaatgtgcaccgagtgtagctgtgccgagcatcgttctagggcaggggtccccaaccccccggccacggaccgatactggtctgtggcctgttaagaactgagccacagagcaggcggcgagtggtgggcacgcgagcgaagcttcatctgtgtgtacagctgctccccattgctcgcatgaccgcctgagctctgcctcctgtcagatcagccagcggcctcagactctcacaggagcgcaaaccctattgtgaactgtgtgtgcgagggatcatctaggttgtgtgctccttaggagcatctgactaatgcctgatgatctgaagtggaagagtttcatccccgaaccgtcatctcacgccccatccccgtctgtggaaaactcgtcttccacaaaaccggtccctggtgccaaaaaggttggagaccgctgttccgggggatggtgcctgactgagctggaggaggcctctgctctccctctggtggaaggagagagaaaacaaagcagaataaatgaggccgtttggactgccaagctgggagttaaaacagtgcagtgtgatttaggatgaggactttaagatgaagaaggtgatacgcttagaactgttgaaagtttaaacttagagctgaatgagaaaaagaaatcggccatgcaaagatgaggggacaacaaggacaagcgccgtgtgttcgaggaagggccaagaggccagcgtgtgtgaggtgcggccggcatgtggtgcggctgggtgcagcgggccagcaggagagggacataacgtgacgtcccagcggcatgagggctctgcgagccaggctgaggatgagttcaggtttccagggcaactgaagggcatggcagggtttcagcaaaggtttaccagatgacactggctgccatgtggagagtagatcacagggagcccacgctctccagtgtgaaagcagcaaggaggtcactgtgatagtgtaggcaaaaggtgaagggactcaggagtttggatcatgagaggaagaggaatccgttttggtttaagcaactggggatgagggaaagggcagagttggcagggggtgggggctaaaagtccatttctggcttggacgggctactgggctcattttcgtgaaggaacagatcgggactggaagacagaaatctgtcatcagcatcaaggccttgaagatggacgaggtcacaaaggggcagtgtctgagcaaggagaggaagagaattcgggagtcagctcggagacacaggaaccagcaaggagcctgcgaagcagctgccaggacgtggaaggagaaccaaggggtctgaggaggagaaaatgatggtgctcggaactgcagaacctctcggcaggcacactgcactcaaacccctgcccgaagacacccggccaccacctcgcggggcctctgggagcctaaggccgcgcccctgggacgccccagcccccttttgagtgagttcccgtctggaaacgctcagggctgcccagagcatgtactgtctgttccggccaacacctgacctccctttctgacagcatttactacaaagggcttaccctgtccctttgagacatctgtgtagcacccacaacccaggggctttcccgagggccccgcagccactccttggaaacggaaacctcaggaggcgcggggcccagtctcccagtctccacgggacggaagcatcccaaccttggtaagcaccggcagctcccacacacggctggcctcgcggcaaggacgctggctgccccgtcatctttcacctgagcctgcactcgccccctcccgactccctccttctcccttcgcaaggccaggccgcctctgctggggcgggaacggagctcagctctctcccccgcaagcaggggtttctgaagaagatctcttttgccagcttgaacaaaggcccgcttttgtgtacctttgtgtatctccggtgttcttgtcaaaagaggaggacaggcacagaggcccgcggggacaaggccacaggatgacggagatggaggctggagaggtgcagccggcggcccccggcgccgtggagaggcctggaaggcagctccctcgcggccctggcggggagcccaccctgccgacaccaccgctagctcagcctccaggcctccagaagcgggaggccacgcgtttctgtggcttcggccccgcagtctgtggtgcttggtcacggcagccccaggagacacagtcagcccctgccccgtgccttgctgagaggctgtgtcaacagcgggctcttccctgccactggcacagaagaaaaccaagctgcgttaccacccgagcgactgtgtgggaagacgtattctctgtgtatcaaaggaatgcgtgcaaatgataggcatttaggaaaggtactaacatgtaaggaaaacttctcattactggccacccagctactcacgtccgtccaaatgttagcagggtatgcactcagagcttttacttctctattggggtcacgctttatccataagtttgtcacctggcctgttcacaccaacatgctacaaggcatgttgcgtgtgaggagatgttcaaaatgccagctgtgccggaccacatcgttacatacgcagcctcttatctcaccccgacctttggcagctacaaatgacgaagtgaagcaccttcccaatgccagagtcatcgctgagtgcccgactctctcttagggttacgcaccagggctgaggacgctgcctacgggcttgctccatcccagcaaatggccccctcggaaagggcagcattgcaagggccgctgtcctgcaccttgccagcagagcgctcacctagggcttcatcggttgccattttcagatcactttttgcttgctgtcagacttgctgttgttttagttactgatgagggtgaaatgctttctcactgtgcttactggtcgcccgcactgttcttgtgcattggtcggcaggagggggagcgcgcatgaacaccagagaacgccacaagctccggcagggatgggcttcgtttgtggatcaaggggccgcagccaatagggcaggcaggctggttccctcccaagagtaatccaaccagttgttctggaagctcaacctaagtaaagccgaaaaggaaaaccctggaatgccgtacttctgcgcaaatggtatggttttaaatccttggtgtctggtgtacggtcaaccctacactgtgctaccggaggagggaggaggcagccccacctccgggcagggcggtgggtctagaccaatgcctggtgggtctagaccaagattctgactcggttggtccagggggcccaagcaggggtgtttttccagctcccaggcactgctgctgcatttgccctcatctgtgtgcactggaacatgtccccatactgggttgtgtgatggccctgaagagatacgtgcatatcttatgggtgtgaccttctttgggaaaagggtctttgcagatgtaatgaatgccgagatgaggagatcattctggattatccaggtgggccctacatccaatgactggtgtcctttatgagacaaaagggaagacacagacgaagaggaagagactgtgtgatgacagaggcagagactagggtgatggctctataagcaaccagcagaggctaagacagagacctgtaaacgattctcttggcacctgcagaggaaaccagccttgccggacatagtggcgggcacttgtaatcccagatactcgggaggctgaggcacaagaattgcttgaaccctggaggcgtaagttgcagtgaactgagatggcaccactgcactccagcctgggtgtcagagcaagactgtatccaacaagaaagaaagagagaaagagagagaggagagagagagggagagagagagggagaaagaaaagaaagaaaaaagaaagaaagaaagaaagagaaagagaaagaaaaagaaagaaagagaaagaaagaaagagaaagaaagaaagaaagaaagagaaagaaagaaagaaagagaaagaaaaaagaaaccagccttgctgacaacttgattgcagactgtggcttccaacactgtgaaggagtttctgttgttttaagccccaagtgtgcagtcctttgttacagcagccaccgtctactcatacaccctccctccaaaaaaaaaatgtaaagtgctcttgtagaaaaattgcaagattaggatttaagtgcagcacccgtgagcagacaagctgtctgtgcctttcacattttcccaagtagaatctgatgggcacctggcttgaaggaggggaaaggtcactccccgcccccacaccccgcccccagatgctgagaaagccctcaggccaggttaatttttagaaggcctcatatcccaattctagccagcctcacactgtcaaatagcaggaagccctgtgaggaagcctcagggtggattcacaatatcccgttcccaaccagggcagcttggaggagggcaggaaggaaggcctgggtgctggggagtcaacttccaactttgtttcctttgctacaattgcagggttaatgcccagggctctgacaccccgggaaatttccagaatcttgcaaaacaagtagagtcgtctgttcttcctaattggggccagtgtgggaaatggcatcacaaacttctggaatatgatgaaacagccatcaccagtcacactgggcaacaacactcttggtgaagacaagagcacgcttcggtgttagaaaaagaaaagtgctcatgtgtgaagcatccctcccacagaccacaaggtggtcacgacgactccaaagtcaaagcagtaaaagggggaaaaaatggataaatgtgactacataaagaaaaaaaaacttcgaggctgagaagcaccagtagtttagcagggtgtggtggcgcacgcctgtgatcccagctactcgcaaggccgaggcaggaggactgctggagctcaggaggtgaaggctgcagtgagctctgattgtgccactacactcccacccgggtgacagagaccttatctcaaaacaaaaaacaaagaaacactagtagcgaggtcaaagcaggaaaagatatctgcaatttctatcacagccacaaacccaatcctgctcatggacaaagagtttctaaaagctgagcaacaaaagataacccagtagaaaaacggataaaagatatgagcagcccagcggggcgcagtggctcacacctgtaatcctagcactttgggaggccgaggcaggcagatcacctgaggtcaggagtttgagaccagcctggccaaagtgctgaaacccccatctctactaaaaatacaaaaattggccaggtacagtggctcacacctgtaatcccagcactttgggaggccaaggcaggtggatcacgtgaggtcaggagttcgagaccagcctggccaacatggtgaaaccccatctctactaaaaatacaaaaattagccgagcgtggtggcaggcgcctgtagtcccagctactagggaggctgaggcaggagaataggttgaacgcaggaggcagaggttgcagtgagctgagatcacgccactgcactccagtctgggcgagaagagcaaaactctgtctcaaaaaaaaaaaaaaaaatacacacacacacacacacacacacatacatatacacaactatacatatacatatatatatatgatatgagcagcccattcagaagcagaactaaaaaaggtccttaaagcctcaggaaagatgtttaagctcactcttaacagagaactgcatggcctagcgaatgacaaaaacccaaacgggctttcccacctcctccttggcaaggctagggaaatagggggtggggagagatgggaaaccaagctccaaggaggaagggggctcaggtaccatctacgccatcgcccatgctcagtggtgtcacttctcagaatctatgccaaagatacgcacgactaatgcacaaggatttttactatgccattatttatggtaacaaaaagatgggaaacaacccaaatgtccatcaatagtgactggttaaatacacatcggtctggctgcaaaatggaatagcatgcagcccaaaaggagagcacccgtgtgcatggtaagagggcagcactcccagggcacagcagcgggcgggtcggtgtccggtgggaggaagagctgccacccagctctgccaggggaagcagttctccctgagagccccaggccccattcttgacttccccagtgccgggtggaggaagagggagggattagcccgaggcaagtggttcgagcagacagaagggaacaaaaagagcagcgagtcaggcctgatcggggccgcatctaccccaaaagaggggaccagcggatcaacagctgaagcgtaaggtgccgcggccagctcctgggtggggctccaggtggcatcccagttgtggccacccagcccttcatcctgggctaggcaggcgggagaggaaagcgcagactgcacggtcccgggcacgtcctcggcaggcagtggccttgcactggccggccctactcaatgcactccatgacatgtatctgcagggtgtccatatcaggggcctgatactggcacttgggacagcagaagtcaggtggctcctcgggggggctcctcctctggctgggcagggccaggggagaggagaggtaggctgggaaaagagaagagtcagagggaaggggaggatggagggggacggagacttggcaggactgtcaatggcaggcctggtctcacaggccactcatgtaagaccaggagccgccactaccacggcatgcctcccttagcctcggggaagggggtgggctaccgatggggtggcctacacgagctcccgccgtcaagtctccagagagcaacaggaaggtcgaactgtgacctcccgcggcgcagcacctgccctccccacccacctcctcccgcaggcccagttctcgctcactcaccaggggcggggggcaagggggcctgggagacctcgacatgccgcttcctcatgtcctcgatcctttgaaaacagaaaccgtccagtcaagccacgcatttctgtaaagctccttggctggactagtgtcaaagcagctcttggaagctcaggtgagaggagagggaccacagtgagccctaacccagaacaccaggagccatccgtctcctgtggtcaccactggcaaccccccagtgtcgcacccactgcggggtcaccactggcgaccccccagtgtcgcacccactgctcacacgggcacgctctcagaggcccacctggccgactcctgacagctggccttcagtttgctgtactccctctgcagctgctccagctgctcctgcaggagctccttcttctcggccagcttctcccgggcctgcctctcagcctggaagtccgccttgtagatatccgcctggcaaatccaacagaaagggatgtgcccgccacaagccagccacccaccaggcactgcgccaggcaccacaggaacaaagcagaacccactgctgtcctcccagagcccccagcggcgcagaggaaacagatacgtcggcgagtaatgccaagctcaccgagaggtctaaggagcagcacaagtggctcagaagcttacgaaaggccactacaaaatgatgccaaagaggccgggtgcggtggctcacgcctgtaatcccagaactttgagagactgcggtgggcagatcacctgaggccagaagttcgagaccagctgggccaacatggtgaaaccctgtctctactaaaaatacaaaaattagacgggcatggcggcaggcgcctgtaatcccagctactcaggaggctgaggcaagagaattgtttgaacccgggaggcagaggttgcagtgagccaagatcgtgccactagtggcactccagcctgggcaacaagagcaaaactcaatctcaaaaagcaaaagcaaaaaaaaaaaaaaagacgccaaagagactctccaggtcccagtgccagggtgggtcagagaggagggccctcacctgggccttcagcaccggaacggtctccatcacaatcttgtgctgctcggcctcctccttcagcttatcgatcacctcctgtttggccaccagggcctcctcggcctgctggagctgctgtttgagatcttccagctgcattccctaaggacgggcaaggggagctgacggagcctcgtcagcccagggcgaggctggctgagaagaactgagaaggatgaaagagtggccctggctgaccaggctgggtgatgccagcccctgatttgagggcccattgcaggatctcagcgtgcacagggagatggctgcgtcctgtcacggcccaaaacgacagaggagatgctgaggtttttttcaggactgaagaggccgctgaggtcatctggtacaacctcccagctgggccgacattcccttcccagaatccccagctccacagccctcctcccacccttcacaggccacaggccacacccactcacagccagccggtcctgtgcccgccatgtgcacagctcagctgagagccctcagtccttccactctgccacctggtcagaggtgcactcctcccacgcaggcatctccagccccctgagacacacacagacacaccccaccaacgcccccctccagagattaagtggccagttttgtagctaactcttccccatgtgacctggcttcaggctttgtccttataaatctcctctgggtacacttacgattgacggtgtcctgctaaaatgtgatcactagcaaactgcaccccagcttaggtctgatgaggacaaactaggaaaaggctcccagccaacactggggtggaaatgctgtcgggcttaccttggcttgggggaagctgagccaggtgccagatggcgatggctggcaagagggaatgtccatggagacaagacgtccccagccccacagagggagcaccccaaggctctggcccagccccccattaagatggcctgctgacactcctgagagcaacatcctggggttgccatctccccacagcttccctgagctgtcgcagctgcagcctgacacaggtctaaggcaagtctaaggcaggtctacccattctcaaggttcagggccacggggagaggaagaggcaaggccagccctagagccccagtggtcgcactcactcgcttccgctcactgcccaccacgctgctcttgatgtggttgtcgtattcttggaagagctggtgataggccacctgcaactgggccagcttcctcctgaggaaagggagcttttgctggagaaaccacctcatgccagtccagccacggtgctgcctgcttccaactctacccccttccttccctccctcgcatcacaggcctggaatggggtcttccaaggctgtgtgaggactcctgaggccgtcaactctaaagcaggctttggtgggctggtcaccaggcagttaatatcgttttcctaaaagctagtatttttaatgtttataataaaatcgcggccagacgcggtggctcacgcccataatcccaacactttgagaagccaaggcaggaggatcgcttgagctcaggagttcaagaccagcccgggcaacataggaaaacgccacctctaccaaaaatgcaaaaattagccaggtgtgctggcctgcgcctatagtcccagctacctgggaggatcgcttgagaccaagaggcggaaggtacagtaagccgagattatgccactgcactccagcctggacggtagagcaagaccctgtcttgaaaataatagtaataatacaatggaactaccctgcactgttcaaaactgtgaacttcacaaacagctcagaaaggcaggggaactgttctagattaaaggagactgaaaaggcacgccaaggacaggaacctgaggtcccagattggatgctggtagacgggggggtttgggggtatttttgttgtctttctgttgcccaggctggtcttggaactcccgggcttaagccatctacccactttggcctcccaaagtgttgggattacaggcgtgagccacagcacctggcctagaaggggttttaaaggacaagtcccctgatgacctagtggctaggaaaaaaaaactacaaaaaaggccacgtgtggacacgcagtgaaacgtggtctggagagcagatggcatgactgtatcaaagacaaaccgggtgtcatcatggtcgcctctaccgttagcaaggctaagggacagaatgggcccacagccacaggcagaatctgaaggagtcctcagaaggcagaaagaaccatggacccgacacttctcagcctttcggctaagatcaagtgtagaaccacagaccctgcggtgcggccccgcccccgctgactcacttctcctccgaggcggcctggcgctccatgcggagcgcggcctccacgctctggccctgcatgcgcagctggtccacctgcacgctgtgctgctgctgcagcgcctcgcgctcactctccagctgccgcgcctgctcgctggccgcccgggccctggcacggggaaagagcagactcagggaggacgaacggggggacggcaggggctatgcgcagggcgtgggcggggggtgggggtcggctctgaacaccctgtgactgcgagctgatgccaggcggcagggtggaggcaccgtcaacagacacgaggacaactgcagggggccaggtgggagcagcaggtgaggagctttgcttaagacgtgtttgcttcaatgcaggggcccagcaggtgaccaagtacagatggcaaggagacctggaagccaggggaagggggtggtccgagaaaaggatggggtcgcctgcatcccgcagtgctggggccaggtgagaggagccctcggaactgcccgtggagttccactgggggactgctgggggccccagcaaaagcagtctcagtggagggggtcaggagagactgctgttccaaaaatgagagactgcccacctgggcgtgcaagcactgagctcaatgcagaccgggcctcggccccatccctgctgctgcccagagctctgctggagtcccagacgacctgctcggatgctcagttcccacacctgcccccctacagctcccttaacctccagtttccagggtctggcctcatcccaccacaccaagcccttccacagcctcactgcagggacaatggtgggtgcatctgtccaggtcctgggtggcctctggccacaggcagacacggcccttctccagtcaccccaactctgcctggcaggcctggctgcttggctctcccctccgcgcctgcctgcatactgcccccacaccctgcacgggttccctctgcccatcagagcctgggtcaagctcccctcccctctgccctgctggctgccccaagtgcaccttgaccgcctactgtgctgggatggctggggcccccctggcagctgatccatctgtctggagggcagaagcaggaccgaatgagaaccacagaaacctccctgccctttgacccaatggtcccactcacaagaaccaagacccctttgcaaaagagagtaaccagcaggcctgaggccaccggctggcaaggttggcccttggctggtgaagttcccttgccacagtgacactttctctagtggtcaggtcggtccctgcacctaggccatttgtaggaagaacgtggttgacgtgagcacccgctctgctgctgggagtcggggatttaggtacctgcctggcagagggcgctgacaggacctgcccccagtaaacacccagggcgctgagtctctagcgggcatccctgggcaggaacacggcccgtgtgggaggcgcttctcactgtgccgctcgcagggcagcgggaggctgggacagggcttctccaactccccccacggctcctgccctggcggctcctgccctgtgcctttttccctgtcatcaacctcagccacgagggcgactgtgcgccggtcccagaagtccttccagagaactagacactgtgggtgtgggctcggggcccccagaatgcctcctaaggaaataatccaaactccatcaaagggtcacagagtgcggagagccggctgggacccaggtcccggatgcctggcccagacctctcccgacgtctgccccgacgtgtttacgcagcctgccccggtctatcctcatcaaggagcaccctggaggcccctaaacccacctcattgcttttggaaaccctggaaggggtctccggagccggctcccccgactcaccgaccctccagagcctggcattccttagtggcagcctccaagcgactctggctctcctgcagctccccgagcaaggacgtcacctgggctttcacagaggccttgtcctcagccatctgctgcaggataaaaagccacttcctgtcagcactgctttctccccagcggcccactcctgccatccgcaagcccggggcaacccgcaagcggctgaggcctgcgcgccatgaggccttttttcctgccctcggcacccccaaacctgggtgccctagggcctcatgagcccaagggccacccaaccctccccagctgcccaccttaaccctctgccacagggtgacacacagatggggcaaaaagagatccccaaagagacgaaggagcacaaagctgccttgaggttgtcaacggcttagtcactgccccggcaagcaggcctcgagggctgaacccggtggccttgcagctacagccccagcaggggatctctctccgtctctctgagacttgggacaaaaggaggccagacacgaatagggcaaagtaaacacaggccccagtccacacccggggccgccaggatgggagagtttgtgcagatcaagagtggacactgaattttgttaaacactgggaactgcagaacctctcggcaggcacactgcactcaaacccctgcccgaagacacccggccaccacctcgcggggcctctgggagcctaaggccgcgcccctgggacgccccagcccccttttgagtgagttcccgtctggaaacgctcagggctgcccagagcatgtactgtctgttccggccaacacctgacctccctttctgacagcatttactacaaagggcttaccctgtccctttgagacatctgtgtagcacccacaacccaggggctttcccgagggccccgcagccactccttggaaacggaaacctcaggaggcgcggggcccagtctcccagtctccacgggacggaagcatcccaaccttggtaagcaccggcagctcccacacacggctggcctcgcggcaaggacgctggctgccccgtcatctttcacctgagcctgcactcgccccctcccgactccctccttctcccttcgcaaggccaggccgcctctgctggggcgggaacggagctcagctctctcccccgcaagcaggggtttctgaagaagatctcttttgccagcttgaacaaaggcccgcttttgtgtacctttgtgtatctccggtgttcttgtcaaaagaggaggacaggcacagaggcccgcggggacaaggccacaggatgacggagatggaggctggagaggtgcagccggcggcccccggcgccgtggagaggcctggaaggcagctccctcgcggccctggcggggagcccaccctgccgacaccaccgctagctcagcctccaggcctccagaagcgggaggccacgcgtttctgtggcttcggccccgcagtctgtggtgcttggtcacggcagctgtagaaaactcatccacttcccacacaggaaatcaacgccttaagccaggcgctctaagccctgagtggagcggcgtgcacagcccaccatccacgcctttccccaggggagtggagcctggctgtggcaagtgccaggtacccgccagcaagtctcctctccagcacttctctccaccttgcccctcaaagggagcacggccccttcctgactaccatcgccaggatcctgcgatcagccaagcccacacacaaagaccctgaaaccaggcggtctgtgctaatgacacgatttatggggggagccttgggccacacagctggacctctggtggctacagccgagtgaccagggttggccacgcaggcgctcggtgcccacgcggcccaccccccgtgaaaaccccggccgccacggctggggtgagcttcccggttgtgactccgtgctcgctgtcccacactgttgccgaaagaaacaggtgccgtctgcacaactcccctgggcgaggagccgctgaagctcacgcctggtctctcctggagcccgccctgtgcgccctgagccttcgctcaccgtaacctgtgtcctttccttgtaataaaccggaactgggagtgtgacggcttttctgagttccgagccctcccggcacagcactgagccccagggtgctttgggggaccccgaccacgggttcccttgtggaacactggcgtcaccgcgggttttcagaacctggccctgccccgactacctgctggcatctcttcaggtgctccacctcccgcagagcctgctccttctgcctcttcagatcgagcttctccaggccgagtctctccaccagtttcctggcctcctggaacttgcacatgaggaactccttctcctccctctggctggcttggaaatgcagaagctcctcgcagcgctcccgcagaatctggttgctctgccggatggcatctggtggcagaggggacagtggaggggagctgggcagcccggcctgccgggccctgcctgggcccacatgggcctgaggctcaggaagtcagaggccagaagtggggccacccatcctggtgcccccacccgccataataccacgcagcttctctcaggggtggatggcgtctcaacactcccttttgtttctttaaacacttccaaaatcctttacactaatgcccctcactttctgcaagaaaataacaccaaacacatcagcttcacttaaaagtacgtctcaaatgtcactttaaaaaattttttatttttggctgggtggggtggctcacgcctgtaatcccaacactttgggaggccgaggtgggcggatcatgaggtcaggagattgagaccatcctggctaacatggtgaaaccccgtctctactaaaaatataaaaaattagccgggcgtggtggcgggcacctatagtcccagctactcgggaggctgaggcaggagaatggcatgaaccccggggggcagagcctgcagtgagctgagatagtgccactgcactccagcctgggcgacagagtgagactccgtctcaaaaacaaaaaaattttttttatttttgtagagacagggtcttgctctgtggcccaggctggtctcaaactctcgaccccaagcgatcttcttgcctcggtaggtacacacgcaaaaacagatggccgcagccttccacacggctgactctgcaaacagcgagattctccctctcccacagggcagtgcgctcgcggatactcctttctctccatctcagggactcacctctctgggtgtctgcatgggagcctcgcccattccccctcctcaccaacctggccactccggcgcccgtgtgggtgtaaattgggggcatctttcaagacagggcagaaggagaacctgctctctgtctgctctccacctcagggagccctcctgccctcttgcgtttcctcctgggcccttgaggccacttgagggaagagaggggaagcctaacacactggagacacagcttcaggaaggaagacacagagctgagccaaacaaaggaggccgctctgggaagctcagggaatgaggccccagaggacagatgagcatcatgggcagagcggggtcagattccccgtgaattcaatacctcagccaagcagggtttacatcctagggcaggaggggaagaggcagctccaattaaggaagggccgccctctggagacaggccccgggtcactccgggggtctccctgcagcgcctgtggtgttgctcccagactcagtgggccagcaggtccctacctgacagttactgtgctcctggatcttcatctttgctccctgggcttctgcttttgtgcccgtgatgttggctgcaggggccagtggctcagcacctggtcaaagttgtttggatgcagttacagctgcaatgcagctggacttctgagtcagcccggccagggtcgcggccctggggcatggtgacctctcccggtgctgcttcccctggggcacggtgaccttgctggggcgggcacatgctggactcgtggccaggtttgcccgggcctccccgtttcaccaggagtcaaactcctctaaccgcgtgtgacgaccactctgcatgtttgagaggacggaagttaagtggactcttcagacttgacttggaattctggaatatgagggctagagggaagcattagggacctcttcacctgaggctggggtgtgttctgccacagccctgacccatgctcccaccagctgtgacagagccctcaagggctggagcgctcactggctcccaaggaatcccgctggcatgacaggaaggtctctctgacattgctgctggtctttcagttttcctttgcgcacctcgggctgaaacagagcgagttcactgcgtccctgcattccaggaagctccccaggtctcagcgtcctctctcagcttccatccgtccctggccttgacagagagccgggcctctcctaacacaccaccgatccagaggagaaggaagccgctcacaccctccggggcaggcatgcggaggtggcattcgcctggcttcctgctgggacttcctcacagcgtgcccacgtctcttggaaaaactcctctgctctgagacagaaccggctttggcacagcctggatgtaccaacccccctcgccttcctcagttgtgcagtgatttgttcagcctttccgcagctggtggacatttacattctaaaaactatttacgtggtggtgtcattaagatgctggtggattctacctcatttgcatatccaggagtttctcagatggattcctcaaggtgggtggaagggaatgtacatctttcccttaatagaaaatgccaaataaatgtccagatagatgttactaccactcctactgacagtgtatgagtcctcgtttccaactacagccttgccaagcattggagattgtcaactaatattattaatcttacattaaaatctgctatgttcccaccgagcaaatgctaaaacaaaactcaaagggatcaagttgtctccgagcaacttaagagcatcccagaacacagctcaagcatatgtctgttttgctttgacaaacagcccctttccaacctagctctgcccaagatggtgccagcgtgacctcccggcagacaagacacctcagcatgtcatgcagaccccacagctgcctgctccctcccctgcctaccattcacgccaagtcctcctttaaaaggccctgctttctgcccccaatgggaagcagtgctcttaaaggcaggagcctgtacgtcttcccctaaaccaagcatggcagaaagtcagtttctttacaggaaaccttgctcttgttcattagactctgcaagcagtaagagaatctgtgttaacattacgtgtttacaaacattttacgctgttcacatttactattattattactttagagtcagggtctcgctctgtcgccaaggctggagctcagggatgcattcatagctcactgcagcctcgagatcctggactcaagccactttcccacgtcagcctcctgagtacctgggactacaggttcctgccaccactccctccacccctaatttttaaatgattcttatagagatagaatctcactacattgcccagggtggcctccaactgcaggtctcaagccatcctcccacctgagcctcccagaacaatgggaatacaggtgtgggccaccatgcccggcccatatcacatgtttaacagtgaaataatgctggttttatgcatctattcaagtacatgtttttgaagcatttttagaaagcacaaaagctcatatgttcaatgaaaacaatttgggaaaaaatttaatgctgacctggaaaaacattatatatgctactgtcatatatttaacatataaatgcaagtatattgaggaaaatattctaaaatgtccacagtagttaatgctgaatggcgggacccagtggcttttcattttcccccatttcccaaattgcctcccgttaccttgtgctacttcaatctgtgaatcccagagcctcccctgcaacccgaggacaagggcatgcaagtccgaaggtgccttcgctcgccgaaaagagactcagacacggaatcgtagctcagctttattttctacagaaacaaacatgtaagccgtcctcctccagcgacaaacaatcaggcccccacaatgaactggccactcgtgctgggaccattccctaggggaggaggcatgacctaggaaggggcgccaggctgggcttagcgcctctgccctgagggagcctgagccaaaaacacgggcagaaagcactgcgtgatccacatcaacagggaaagctgctggagacaggagctgatggagagctgcagttggcggtggtctgcagcagtcagtcggctaaatgtgaggggcagagaacatcacattaaaggcgacacctctgcacccatctccctgggctccctcgggtggcggcgggcctggtgtaccaggtctctgttctgagaccttgtgtttgggtgttctgagatctctagctttctgcccctccggggaggcggatcccagcccccaacccaccaccctcatccgcccagcgccttccctgtcctggtcccgaactgacataaacagtaggttgccggacacggtgaagtccttcagaaccgcccctggtcgggggagaggtgcggcatcccgggacaggatcctgcggaccagctccgcttccatgggcgacgagaaaggcatcgtgatgtgcctggtggggacccagttaaggtgccatctcctaggatttggccggtgcccatctcatcccctcaggctgtctccccacgcactggcccaggtcctgcagcaaccccacccagctgtcttgattccccactttcctctgttgcacctcaagctgactcctgcgtgcccttccaaggccctccccaccatgccccctgccgcatcagccgggacctctccccatcgcttgacaccacccccatccagcccacaccccagccaccggctcccaccttgcacgcttccccccaactcctgatcccttcacacacccaagaacccctgtctcctgtccccctgcccctcaccccatcgcccagcacccaactgtgcacacgctccacctcccatcccctacctactcccttcctctgagccacccctcgacctccaactcccagcccccacccccaccccacccggccccttacccccatctcccaaaccccaccttccgcacctggccctgccctcacccacctcctggccctgccccccacctcttgaccctgttgtctccgtctcacggcccccacctcgccaccagaacctcctagaacagaacagaacaggatacaactgaagcaggcggctgtccggcctcctggccccgcaggggcaccttccatcctgcgcagaagcggcaccgccatgcggaccccgcggggcgcctcctctcggccccgaggcccttgctgcccctgcgccccggggacctctgccgcccgtggcacccgcctctcctgggccgccagcattgccccctgggccatcaggaatgccagggcctcctgggccatcagcatcgcccgtcgaaccccctgtgccctggccttcggcctgcatggctccggagcctctgcccggctctcagagagaaggtcagggcccacgaggatgcggaggcagagaggctgcaggaagttccgccccctggcgtgagatgggcagcccgggatcctcagggcgcctgcgcacaggggccctacttccggccctgggagaccccgagtgagccccggagcacgtgaccggttctcaccaaccccgcccctccccaagagagcccgggccggaaggtggccgcaatgccagcttggacccctcacccgtgagcagccggctgtccgccggacccctgtcccgggagccctgcagggagtcaggcactgcggggcccagcctgtcccatcccccgggtctccctcacatcgaggagcaagacgggcctgggaacacggggccgggactgtgcggccatcgtcccggaccctgcctgccctgtccgtccttgggggagcgcccaggacagaccccggggggcaggcctctaactgggctcagcagcctccgtccctgtcctggtcgcccagctggtggggtagctggaactgcatgtctggtgggcgtggcctcgcgccagccaaggtctcccaggcgccaggtccagccaaggtggacgggagggcccagcgggacccggggccggatctcactcctgggttcaacgggttctgtccctgtcctagtcgccccgcctggtgggggagctggagctgcgtgtggggtgggttgcgggtggcctcccaccagccaggggctcccgggctctaggcctggcccaggtggacaggcgggacctgctggacctgaggctgggtcgggcctggctcctgggttcggcagtatcagtccctgccctggtcgctcttgcctggtagggagctgggaggtgaccctgtgtctgctgggtgctggcttacttctgtgtctggaagggggtcagatccacaggaaaggtgctgcgagaggcgggcaggggtgggggtggcatggccctaggagctgggtgtctgtccccacgccctgttcacaagtctgtggggcgagaggctgcaatactccatcccgggtgtctgggctgctcaccaggccggctcaggcttcccacatcctgtaccctgggttgggcatgaaaccgatccaatcgtcccataggctgttctttttgatacacatagaaactgacccttctggtcttcaagcttgaaccttacagttgttttatctgaattccttcctcaggaaatgaccttcgggcctctcaaaatatcaaagaactgaaactcaccagataaccacatccagacaatgagatgctggaccccccaaattcatcaggattgctttctgggccctcccgagttcctgttttcctacacattggtgcatttcttcctggctatataaacccctagttttagtcagggggatggatttgagacttaactcccatctccccggctgcagcacccaattaaagccgtcttccctggtaatgctcttcgtctcagtcagtcattggctttctgtgcggccagcagcaggacgtagaccaaacccttggtatttcggtaacaggcacacccccaggaagggaccccggacacggctaccacctctaggcttaaagcgaatgcacttcccgcatctccagtcttccgtgtagcagctttaacctatgtatgtctgtgccacatccagtcctcagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttctgcctctgctgctctaagaaggggtcagggtgcaggaggcagggggaacctcctccagctggagctgctgcggtgagcaaggctctgctctggaggcctctgaggctggcacccttctggggactgggaagggggcagggaaggcagcagcccagggaaagcctcgtccccccggagccgaggcagttggggagagcaggacgagagtgagctggagagcagccacaccgatgggtaagggtgggtgaagggattccacaggtgtctagaaaactggaaagagctccttagcaggtccaggccccaggtgtaggggaggaccagatgtggaggatgaagacggttgtccagagggatctccaggcgttggcattattgggtcctactgagatgctgtcaaggagaaaacacaggctgtgtgtggcagggcgacaaatgagtgctgctgccaagctctgtcctgttttctgtgcacgtctcagagcccctccagtgaccgtcatctccggcctcctcctgcgcctctgtgttcgtagacatcttctcacatctcagatcctgctgagcctctgggccccctgcacgtgccttctgcctctcggctgctggggtggggacctctgtgccctgtgccagcgcctctcctgcagctcacaacacatctgctttttctcctgcgccctgcacagggtgggcctggaagctctggggaagttgtacccttggacacagccccccaccgatggggccaagagtcactggataaaagtcttagtctctcaccctttgaaggacaactctgaggtgcggctgactgtggagcgaatgaaatgaaacggatgcacggggatgggtgtggacaaaggaatgccgacttctcaggctgccgatacatatctcagtagaagcacgggggaatgctatatagagaaatatttctatagtatctgaagtgtttagaatgtattgacctaatatatacacaataaaagtaaaaacattggaagaaaatttagatgaactttatttgattgttggaatggaaaagacttttctctctttctttctttctttctctccttttctttctttctttcttttctttcctttttttcattattataccttaagtgctggggtacatgtgcacaacgtgcaggtttgttacataggtatacatgtgccatgctggtttgctgcacccatcaacttgttgacctagcaatcccattactgggtatatacccaaaggattgtaaatcattctactataaagacacatgcacatgtatgtttattgcagcactcttcacaatagcaaagacttggaaccaacccaaatgcccatcaatgttagactggattttaaaactgtggcacatatacaccatgaaatatatgcagccatgaaagagaatgagttcatgtcgtttgcagagacatggatgaagctggaaaccatcattttcagcaaattaacacaggaacagaaaaccaaacaccgcatgttctcactcgtaagtgggagttgaacaatgtggacacagggaggggaacatcacacaccggggcctgttgggggtggggggctgggggagggatagcattggaaaagacttttctaagcctactagcaatgagaataataataaccaataacatttgttgggtggtcaccacgtcccaagccactgttgtaagcactagacaagaattggctcatttatccagaaatacaccacattttcattgtcgttatccttggcggtgagataacggttggttttttattttctcttccgaacttgcccatatttcctcttcttttgcagtgaacatgtattacatttataagcagaaagcgattaagaaagttattcattacttgctgttgaggaaaatttctaattagctctggagtgagccagtttgccaaagtttaaattagcctgttcaattcattggaggccatatttttcctctgaaacttgttctaattggcaccttttcttgatgtaatgaggcggacggtgccgtgatgaagtctctgaagtcaccgagcctcggggcccacgctagacaccacggggcagatgtcgcccggctctcccggtcatctctgtggctttcagccgcttccaaaaaacaattgtttccaaattccacacacacagttcatcctaccttgaaagttattcctccagagggctgttgatagtttgcttcatcagcattttgtcactattacacagtgagattttttttttcttctgcaccttggaggtactcatgaagaacacatgtgtgcttaaacacaaaacctaccgaggcccataacagcccctcccctccagagggccggtcctggtccacacacgctggcagacagtctttgtgtttccgaatcagagaagacttgcttggaatggatgaaatgtatttgaaatcacattaggcatcatctggaatggtgaagcttcagaggtgacagggccaggatgtctatattcaaagagggccattgaattaaagttaagcagggatctctttgcttgaattccagagtttcaaaccagcacagtcatgtgagcttggatggcctgtaggtacttccaacccaacctgcccccagctgacctcactgcctgtcccccgactcccggaatggcttccctctgcttcattctctgtcttggcgacacgcgtttccatggtcccgcactctgtcatctcaccttccgtccagtcagtttccttcaatgtgtcctctccaccctccctaggccaggtcggcatcatctctcacctatatgatgagaacaatctcccccggtctacacagattcccggcccctttcctaggaatttggcctgagtggggcggtctaagtggggatgatgtaggctggcctcatatggcccagggggagggcccagccatacctaccagggctgatgagcacggcttgtttcgccctgtgggggtcattgcaggctcttgtgcgggactcgggatgggggtctgttgggaagccccggatggcctagtgtcctggccttgagcctttggtcttctctgagcgcccacccgccatcacttgagaacagtgaaaggcagctgtgttgaccctttgagcagcatgtggccgttcctaggtttggtggtaggggtgagtgaccctttcctgtgaaggaatggcgagtaaccattgtatgacagtgaattgtcttagtgcctaatagcccagcctactttgtgagctccataaaggcaggaagcttgtctggagcttttctgtatccccagtgccaaaccccataatggggagacacgaggtactctctcattctttctttcaagaaatatttcctggccggtgcggtggctcatgcctgtcatcccagcatgctggggaagatggggtttagcatgtgagtgaggaccacacatagcacagagagcacccagtcgcccaagccagagtatgcagagttgggaaggatgtagcaggggactgaagtgacgtagaaaagaccgatcatagcgagatgggcaacacaggtagaaaaggcttttcttcagccctgggtggaatgaatcctgaacagcagccacaacgtgtccataggagaccacgaccaggacgcagtgtgcaagagccaccagaaaactgaagaacagggcaagttcattggtacgtgtgctgaagcaagagagtctgagcagtgacggaggtcgcagaagaagtgggtgatgaggcaaggcctgcagaacttgggtagagctgtgaggatgctgtaggtgaatgcgttggccaaggccagcaggcaggagatggaagtgaggcccgtgtgggtcagtcggcccacgaggacaaagtagtgcaatggctggcagatagctgcatagaatcataggccacggctgtgaggaggaaggactcctagggtgccaggaagtggagaaagcatatctggatgagacaagcacaataaagtacgggccctaccggagccagcaaatgcaccagcacctgagtcaccatgttggagatacaggcggcatccatcagcgagtggccgcccaagaagaagtacatgggagtgtggcgtcggtagtccactgtgaacatgtggctcccaaccacaaccactatgtagattagcagaaaggtggtgaacagcaggggcctccaagccttgctgtccctcaggcctttcagaagaaactgggacactagggtcccattccgcagctgcttggaaccacgcacagaaccctgcacctgtagtatgcaactcagagtcagatgagggtctaggtgtggagtcccaacttacaagggggggaggggatgagggatggactaatgactaggtaggcaggtttcagatttaatggaggaagacttgttggttcaatacaatgaggagcctcaaatggccaggcaaatctttcatctcctgttgaacagagccttttttgggagaaagtgatggggatcagcctttagggtatccatagatggctttgctggcaaaactgtggcaggtgggagggcagatacatatacagaaaatgtctctattcctgggacaaaaatcctcctgctccctgaatgagagaatgggtccaatataatccactttccaccaggcagctggctgctccccttgaggtgacaacctaataagcgttgctttacgttgggtacacggcagaagtacccagatcagcctcggtgtggtgaagaccatgttgtgtcatccttcccgtagctgtgtctccagtctccctgtttgcagagtcagcccaagctgtgtggaagcctgcggccaccagctcgtgcatacctacctatctatgtgtccaaaactaggtctgtcagctcaaagacatcaggacaaaagacaccaacctgtcttgtctgtgaggaaggtgttgggggaggaagagggtgcctggtgtctggagtggcttgtggcttgagggagcatctcaccgagcaaggtccccacagagagcctacccctggggctgacaccgtatctacgtcctgttctccgacactttgccctctgcaggcagcattcttctcttcttaggcctgttcaggaggaacctgcagccagagaaccggagccaaaaccacagggccctctgcacctaggccggagcatgagtcgaggggtcagaccaggctggcttcccttcagttgtagccaacttaagtctttgctttcattccccagataatctgaccccgtggaaagtaattcaacactgcagaaatgactgagatggagtgaaagtttacacatgcacactcccccgacaaccaacagagtgactactgttaccacactgggtaggtgcttcatagctagagttcgtgttctacatatcacataaggctatatctttgtaatttctttccttctactaatgttgtgcttactttgttcttgtgattctagtttcttgaaatgcaacattaggtcatttatttgagatatttcttctttttggtgtacgcatttattgctataaacttccctgttagaactggttttcctgtattccataggttttgatatttttttccaatttccttactcccagggaatgtttaaatttcccttttaatttcttaattgatccattgattgttcagaagcatatttttaaatttagatattaataaggtttggctctgtgtccccaaccaaatctcgattcaaattgtaatccccataatccccatgtgttaagggagggactgagtgagaggtgaatggatcattggggaagtttctcccatgctgttctcctcatagtgagtgaattctcacgagacgtgatggttttataagaatttggaagttcctccttcactctctcttctctctcctgctgccttacaaagaggtgcctgcttctcctttgccttccgccattattgtaagtttcttgtggcttccccagccacgcagaactgtgagtcaatcaaacctcttttgtttatgaattacgcagccttgggtagtatatttatagtagtgtgggaacagactaatatagtaaactggtactgcagagaatggggcactactataaagatacctgaaaatgtggaagtaactttggaactgggtattgggcagaggttggaacagtttggagcactcagaagaagacaggaagatgtgggaaaccttggaacttcctagagacttgttgaatggctttgaccaaaatgtttttttttttttgagacggagtctcgctgtcgcccaggctggagtgcagtagcgcgatctcggctcactgcaggctctggccccggggttcacaccattctcctgcctcagcctcccgagtagctgggactacaggcgcctgccacctcacctggctaattttttgtatttttagtagagacggggtttcactgtgttagccaggatggtcttcatctcctgacctcatgatccacctgccttggcctcccaaagtgctgggattacaggcgtgagccaccgtgcccggctgaccaaaatgttgatagtattatggacaatgaagtacaggctgtggtggtctcatatggagatgaggaacttcttagaaactagagcgaaggtcactcttgctatgctttagcaaagagacaggaggcattttacccctgacccagagatctgtggaagtttgaacttgagagagatgatctgaaactgaaacttacgtttaaaagggaagcagagcataaaagtttcgaaaagttgcagcttgatgatgcggtacaaaagaaaaacccattttcttgggagaaattcaagtcagctgcagaaattagcataagtaatgaggaggctttttaaaaaatttttattttattttaagttctgggatacatgtgcaggatgtgcaggtttgttacataggtaaacgtgtgccatggtggtttgctacacctatcaacacatcacctaggtattaagccctgcctacattagctatttatcctgatgctggaggagccaaatgttaatcaccaaaacaattgggaaaatgtctccagggcatgtcgtagatcttggcagcagctcccccccatcacagacccagaagcttagaagggaaaaatggtttcctgggtcgggtccagggcctctgctgctctatgaagtcttgggacttggtgttctgcattccagctgcaccagctgcagctggggctacaaggggccaaagtatagctcaggcagtggcttcagagggtgcaagccccaaaacttggtggcttccatgtggtatggggcctgtgaattcacgaaagtcaagaagtgaggttggggaatctccgcctagatttcagaggatgcatggaaacacctggacatccaggcagaagtctgctgtaggggctaagccctcatggagaacctctgctagggcagtgtagaagggatatgtggggttggagcacacatagagagtccccattcactagaatggcattcacccatccaccagaaatgctgggtgatggttcaccaattattatgttgcctctccgagagtgataatctgaccatgccagggggacaggccatttcctgatggtccacacctgttaacatcaaaatgttaattggatgcaggccccagggagaagaaactttctgggcatgcatagtaagagacaaaaatggtgaagtatgatcttccactggagaaaggaagaaagcctcaggtgggcatgcatgtataactccctagacacactgggcatgctcacttcccaagggtaaggagggctctatgcatgtgggcagcccaccctaagggaataatcatgggaaagaggtaagcttataaatgtcctaggatcacagttaaacagggcatttgaccttctctctttaattaaaccttcatgtgcccccttgggtctcttccaagtgcaccttgctttcctgttgtaaggcattttaaaataaacttccattcctgctctggaacttgcctcggtctcttttactgctttatgccctgcagtcgaattctttcttctgaggaggcaagggctgaagttgctacggacccatacagataggccaacagtaacatggggtaactcaaatttctgccactgctaacaagttctcacaagatctgatggttttgtaaggcagttttccctgctcttactcactctttctcacctgccaccatgtaagatgtgcctgcttccccttccaccatttcctgaggcctccccagccatgcagaactgtgagtcagttaaacctcttttccttataaattacccagtcttgggcatgtctttccagcagtgtgagaacatactaatacagatatatgtgtggattatccgaagtccctcattttctagttttataccattttgtgatcagaaaagatacttgatatgatttcagtcttcttgaatttgttaagacttctttggtggcacaacatactatatatctcagtgaatgttccatgtgcagttgagaagagagtgtattctgcagctactggatggatttttctgtatatatctgttaggtccatttgctctagagtgtagtatatgcttgttgtttgcttatttatttctgtcttgatgatttgtccattactgaaagagggttgttaaagtcccctagtattattgtattgcagtctgtctctttttcagattaattaatatttcttttatatatttaggtgctctaatattgagtgcacatatgtttacaattgttatacccttttgttgaaatgaccactttatcattacatagtgattttctttgtctctttctagaggttttgacttaatgtctattttatctcatgtaactatagctattcctgctctctttgtgttttcatttgcgtggaatatcttttttcatcccttcactttgactctatgtgtctttacaggtgaaatgagtcccttgtaggtagcaaatgtctgcgtcttaatttttaaatccatttagctagtctatgtcatttgattggacaatatatcccatttacattcaaggtaattattgataagtaagaacttactactgccattttgttaattgttctctagttgctttgtcgattctcccttttctcctctcctactgattttctttgtggttaagtgatcactcttgtagtatgttttggttcgttgtcttttattttttgtttatctgttatagctttttgctttgtggttaccatgaggcttaaaagaaacatcttaaagttataacaggttattttaagctggtaacaacttagatcacaaaaataaaaacctctgcacatttactccactccctccacacacatttttttgagacaggaactcactgttgacctggttatagtgaggtggcatgatcacagctcactgtagcctcgaccaacagggctcaagtgatcctcctgcctcaatctccccagaggctgggattacaagcacaagccaccatgccgaggtaattttttttctttttactacagacgaggtatcctcatgatgcccagtgcggtcttgaactcttgagctcaagcaatccttccacttcagcacaaaattctggcattacaggtggcagccactgcatctagcccacattttgagtttttcatgttacaatttacaacttttcatattgcatattttaaaataaaccattgtcgttattcttttttaattattacactttaagttctagggtacatgtgcacaacgtgcaggtttgttacataggtatacatgtgccatgttggtttgctgcacccattcactagtcatttacctcaggtatttctcctaatgctatccctcccccagccccccaacccacaacaggccctggtgtgtgatgttccccatcctgtgtccaagtgttctcattgttcaattcccacctatgagtgagaacatgcggtgtttggttttctatccttgtgatagtttgctgagaatgatggtttccagcttcatccacgtccctgaaaaggacaagaactcatccgtttttatggctgcatagtattccatggtgtatatgtaccacattttcttaatccagtctataattgatggacatttgggttggttccaagtccttgctattgtgaatagtgccacaataaacatatgtgtgcatgtgtctttatagcaggatgatttataatcctttgggtatatacccagtaatgggatcgctgggtcaaatggtatttctagttctagatccttgaggaatcgccacagtgtcttccacaatagttgaactaatttacactcccaccaacagtgtaaaagagttcctatttctccacatcctctccagcatctgttgtttcctgacactgtaatgatcgccattctaactgacatgagatagtatctcattgtggttttgatttgcatttctctgatgaccagtgatgatgagcattttttcatgtgtctgttggctgcatagatgtcttcttttcagatatgtctgttcatatcctttgcttactttttgatggggttgtttgttgtaaatttgtttaagttctttgtagattttggatattagccctttgtcagatgggtagattgcaaacattttctcccattctgtaggttgcctgttcacactgatggttgtttcttttgctgtgcagaagctctttagtttaattagatcccatttgtcaattttggctttggttgctattgcttttggtgttttagtcatgaagtccttgcccatgcctatgtcctgagtggtactgcctaggatttcttctagagattttttggttttaggtctaacatttaagtctttaatccatcttgagttaatttttgtataaggtgtaaggaagggatccaatttcagctttctacatatggctagccagttttcccagcaccatttattaaatagggaatcctttccccatttcttctttttgtcaggtttgtcaaagatcagatggttgtagatgtgtggcattatttctgagggctctgttctgttccattggtctatatctctgttttggtaccagtaccatgctgttttggttactgtagccttgtagtatagtttgaagtcaggtagcatgatgcctccagctttgttctttttgcttatgattgtcttggcaatgcaggctcttttttggttccatgtgaactttaaagtagttttttccaattctgtgaagaaagtcattggtagcttgatggggatggcattgaatctataaattaccttgggcagtatggccattttcacgatattgattcttcctatccataaccatggaacattcttccatttgtttgtgtcctcttttattttgttgagcagtggtttgtagttcttgaagaggtccttcacatcccttgtaagttgtattcctaggtattttattctctttgtagcaattgtgaatgggggttcactcatgatttggttctccttttgtttgctattgatgtataggaatgcttgtgatttttgcacattgattttgtatcctgagactttgctgtagttgcttatcagcttaaggagattttggaatgagatgatggggttttctaaatatacaatcatgtcatctgcaaaaagggacaatttgacttactcttttcctaattgaataccctctatttctttctcttgcctgactgccctggccagaacttccaacactatgtttaataggagtggtaagagagggcatccttgtcatgtgccagttttcaaagggaatgcttccagtttttgcccattcagtatgatattggctgtgggtttgtcataaatagctcttattattttgagatatgttccatcaatacctagtttattgagagtttttatcatgaagagctgttgaattttgttgaaggccttttcttcatctattgaaataatcattggtttttgtcattggttctgtttatgtgatggattacgtttattgatttgtgtatgttgaaccagccttgcatcccagggatgaagccaacttgatcatggtggataagcttttggatgtgctgctggattcggtttgccagtattttattgaggattttcacatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtactagctcctttttgtacctctggtagaatttggctgtgaatccatctggtcctggactctttttggttggtaggctattaattattgcctcattttcagagcctgttattggtctatttagatattcaacttcttcctggtttagtcttgggagggtgtgtgtgtccatgattttctagtctatttgcatagaggtgtttatagtatcctgtgatggtagtttgtatttctgtgggattggtggtgatatcccctttatcattttttatcgtgtctatttgattcttttcttttcttttctttttgagacagagtctcactctgtcgctcaggctggagtgcagtggcgcaatctcggctcactgcaagctccgcctcctggattcacgccattctcctgcctcagcctcctgagttgctgtgactacaggtgcctgctaccacacccggctatttttttttttttgtatttttagtagagacagggtttcaccgtgttagccaggatggtctcgatctcctgatctcgtgatctgcccgtctcagcctcccaaagtgctgagattacaggcctgagccaccacgcctggtctatttgattcttttcccttttcttctttattcgtcttgctagaagtctatcaattttgttgatcttttcaaaaatccagctcctggattcattgattttttgaagggttttttgcgtctctatctccttcacttctgctctgatcttagttatttattgccttctgctagcttttgaatgtgttttctcttgcttctctagttcttttaattttgatgttagggtgttgatttgagatctttcctgctttcccctgggggtatttagtgctataaatttccctctacacactgttttaaatgtgtcccagagattctggtacattgtgtctttcttctcattggtttcaaagaacatctttatttctgccttcattttgttatttacccagtagtcattcagaagcagtttgttcagtttccatgtagttttgtgatttttaatgagtttctcaatcctgagttctagtttgattgcactgtggtctgagagacagtttgttatgatttctgttcttttacatttgctgaggagtgctttacttccaattatgtggtcaattttagaataagtgcgatgtggtgctgagaagaatgtatattctgttgatttggagtggagagttatgtagatgtgtattaggtcctctttgtgcaaagctgagttcaagtcctggatatccttgttaaccttctttcttatctgtctaatattgacagtggggtgttaaagtctcccattattattgtgtgggagtctaagtctctttgtaggtctctaaggacttgtttcatgaatctgggtgttcctgtattgggtgcatatatatttaggatagttagctctttttgttaaattgatctctttaccattatctaatggccttctttgtctcttttgatctttgttggtttaaagtatgttttatcagagactaggattgcaacccctgcttttttttgctttccatttgcttggtagaatttcctccatccctttattttgtgtctatgtgtgtctctgcacgtgagatgggttcctgaatacagcacactgatgggtcttgactctttatccaatgtgccagtctgtgtcttttaattgggtcatttagcccatttacatttaaggttaatattgttatgtgtgaatttgatcctgttattatgatgttagctggttattttgcccgttaattgattcagtttcttcatagcatctatggtctttacaatttggcatgttttttgcttgtctgtaaaggattttatttctccacttatgaagcttagtttggctggatatgatattctgggttgaaaattcttttctttaagaatgttgaatattggccccctctcttctggcttgtaaggtttctgctgagagatctgctgttagtctgatgagcttccttttgtgggtaacctgacctttctctctggctgcccttaacattttttccttcatttcaaccttggtgaatctgacaatttgtgtcttgggcttgcttttctcgaagagtatctttgtggtgttctctgtatttcctgaatttgaatgttggcctgccttgctaggttgggggggacattctcctggataatatcctgaagagtgttttccaacttggttccattctccccgtcactttctggtacaccaatcaagcctagacttggtcttttcacatagtcccatattatttcttggaggttttgttcttttctttttactcttttttctctaaacttgtcttcttgctttatttcattaatttgatcttcaatcactgatatcctttcttccacttgatggaatcatctattgaaacttgtgcatgcatcacgaagttctcgtgccatggttttcagctccatcaggtcatttaaggtcttctctacactgtttattctagttagtcattcatctaacctttctttcaaggtttttagcttccttgcaatgggttagaatatgctcctttagctcagagaagtttgttattactgaccttctgaagcctacttctgtcaactcgtcaaagtcattctccatccagctttgttccattgctggcgaggagctgcaatcctttggaggagaagaggcactctcgtttttagaatttttagcttttctgctctggtttctccccatctttgtggttttatttgcctttggtctttgatgttggtgacctacagatggggttttggtgtagatgttctttttgttgatgttgatccaattcctttctgtttgttagttttccttctaacagtcaagtccctcagctgctggtctattggagtttgctggaggtccactccataccctgtttgcctgggtatcaccagcagaggctgcagaacagcaaatattgctgcctggtccttcctctggaagctttgtctcagaggggcacccatctgtatgaggtgtctgtcagtccctactgggaggtgtctcccagttaggctacacagggttcagggacccacttgaggaggtagtctgtcagttctcagagctcaaatgctgtgttgggagaaccactgctctcttcagagctgtcagacagggacgttttaagtctgcagaagtttctgctgccttttgttcagctatgccctgcccacagaggtggagtctacagaggcagtaggacttgctgagctgtggtgggctccgcccagttcgaacttcctggccgctttgtttacctactcaagcctcagcaatggcggatgcccctccccccaccaggttgctgcctcgcaggttgatctcagactgctgcgctagcagtgagcaaggctctgtgggcatgggacccaccaagccaggcatgggagagaatctcctggtctgctggttgctaagaccatggggaaagtgcagtatttgggcagtagtgtcccgtttttccaggtccagtctgtcatggcttcccttgtctgggaaagggaaatcccctggcccattgcacttcccgggtaaggtgatgccctgccctgctttggctcaccctccgtggactgcacccactgtccaaccagtcccaatgagatgaatgaggtgcctcagttggaaattctgaaatcacccttcttctgcatcgatcacactgggagctgcagaccggagctcttcctgttaggccatcttggaatggagccccattgtcattattcttaatagttttgtcttttaaccttcatgctaaagatgtaagcaaagtatacaccatcattactgtaatattgtaaattgaactgtgtactcacttttatcagtgagttttataagttcagatgttatattcattagcatccttttctttcagcttgaagaactcccgttagcatttcctataagataggtctattgattatgaatcgtctctgcttttgtttttctgagaaagtctctattgtcttgattttctgggtatagtgttcttagtaggtagttcttttcttccttcagcactttgaatatactatctcactccctcttggcccataaggtttctactgaaaagtcagttaccagacatattggaactcccttatgtgttatttgcttccttcctcttgttgctttcagaattctctttttgtttttgttatttggcaatttaattctaatatgtcatggggtagtcttatttgattcaatctgagtggtgtcctttgaccttccagtacctgaatatttatatttttctcccgttttggaaattttctgctattatttctttaaataagctttctacctagttgtttttctcagtcctgcttgaactctgatgacccaaacacttgcccttttgatgctatctcataaatcccttaagcttttttcattcctttttatgatccttttttttgctcctttgattggataatttcaaatgtcctgtcattgagctcccttcttcttctttcttcctcttcttcttcttcttcttcttcttcttcttcttcttcttcttcttcttcttcttcttcttcttcttcttcttcctccccttcttcttcttcttcttcttcttcttcttcttcttcttcttcttcttcttcttcttcttcttcttcttcttctttcttcttcttcttcttcatcttcttcttcttggtctattctgatgttgaggcattctattgatgttttagggttcaattgttgtattctacaattttttttgagacagagtatctctctatcaaccaggctgcagtgcagtagtggaatcttggtcactgcaacctcctaggctcaagcaattctcccacctcagcctcccaagtagctgggaccacagtcttgagacaccacaccagcctattttttgcaatttttgtagagacagggtttcaccatgtagctcaggctgatttcaaactgttgagctcaattgatccacctgttttggcatctcaaagtgctgggattacagacgtgagccaccaagctccacaagtgattgtattcttcatctttaggatttctatttgatttgttgttgttgttgttgatgattgtttccatttctttgtcaaatttctcattttgttcatgaattgttttttattttatttgattatctatttgtatttttatagttctctgaacttctttaagagggttattctgaattatttgtcagttatttcatagatctccttctctaatgggtccattactgaagctttattagtttcttctcgtgtgttgtatttttcagattttttcataatctttgtgtttttacattgatgcctgtgcatttgaggacctagccacgtctttcattctttgcaggtattctttggtgataatagacctttactatttagtctaacctgagattctgaatgagccagctggttgcaaccatatacaagcagtctttggtgtcatgttcttgagttgcttcctgcgctctgaggttgaatggtagtgctgcctctgcaccatggtccaatgagaccactggctggagtccactgtcaggtggggctgctggctgggctctgcaatcaactctgattaggcagggttgcagttgtcttcccaggccatgtggtactattgtttggaatctgtattatatttcctaaagtgtgatgccgttggctagtttctccagcatggtgcctccattggctagaatgcagagtaaccaccaaaatctgttcccttgtcactgtaagctccaccccaatcctccatctccaacttaccccaggtgtccagccctgctggcactcccaatgttccctgaagtatgtgacaagactgagcctcctgaaaggggttcagaatggtggggaagacaaatgtcagcctccaactcactgctcccacagtagaaactatgagctcagaaaaattctgtgtgcggtactgtgccagcctggaggaagggcagcaaggttagaaagaattgttcctcttaccatctgattgtgggctttctagattctgtagttcaaaggggtgtctcacattcacttctgagttctgtggtgctcacaatggtggtcttgccttttgatagttactggttggatttctgtttgggagagtaaagctggagaactcctattcttctacatggctgagatcattcctatatttagactataatttattcttatttcttgttttcttttcatttttttaaagacaggggcttattctaatacccaggctagagtgcagtggcatgatcatagctcactgcattctcaaactcctgggctcaagttatcctcctgcctcatcctcccaagtagctaggattacaggtgtgtgccaccatgccaggctaatttgttgtatttttatttttgtagagacagggtctcactatgtttcccaggctggtctcaaactcctggcctgaagcaattcttccacctcagcctcccaaagcactgggattacaggcatgagctactgtgcacagtctagtttgcttttctatatctgattttctaaaatattgttctatcagttactaaaaaaggagtgtgaaaatattcacctctgtgggtttatgtattcctttttttctatgagtttaacttcatgtattttgaagctctgttatattcagtgcacacatatttattgtgtcttcttcatgaattgaaccctttatcattaataaatgtcctccatcccattttattctgtgtattccatgggtgatgagaaaggcatcctgatgtggctggtggggacccggttaaggagtctctcagttggccttatgggccaacctgctgttttgtgggtcagagatttggtctagagtgtgtgtgtagggaaaaagtgttcttgattggcctcatacttcaccaggggtgagggatttaatgtggctttttgtcctttctctaggtcccaggatcccccaggcctgttctctctatgcctttggcctgtttcccccaaacctgagcccgccccctccctactttctttgtcctttccttgtttcacggcctcgagatgccactgacccagcacccagggcatctgggagactcagctatggagaaaagggaggtggtggcaaaagagatgcctgctggggcaggcaggcgtagggcagttaccatctcatgcaagtaatcacgaaggtcatgttatacatggtgtcagggagagcagttgattttagtgtcaattatcaaagcgagtttccaacgaagaaattaagaaaatgacaagatatggtttggctgagccgaagcagtactgattacagacacctgctcaaatgtttgcagtgaaataacatgcacgtgagtcaggttaagtttgttgtacttcaacgtaaaagtggttatgaagtccattttcaaatattccgctttcaaaacatgttccttatttatattggatgtcatcagttaaataaaaaagaacttaagtcacgatttctccttataagacttttattaatgccagaaatgaaacagcaaaaacaaaatgaatttgaaaaatcagtgtgattgtgggtgcagagatggtatgaacagggactgaggaaaaagccaggtctgaggagagccttcagtttcaactcggaacttttaaaggtcatgattcagctgatcctgtgaagtggactgtacagtgggtaggtcgcttcgtgtctttatagccaggctgtgtgctggacatcaaggctcttccctccccaaggaaagcttaactcccagtgctcctgggtttgtcaccttctggacttgcaggcttgagacccttgggtcccccgtcctgcactggacgacccctgactgggaggaattttctaacgaggtgagacagaagaaaatgaaacaaaaaggaactacagaaaacgatgtggggttaattgctgcattgccctgttatgctgattcccacatcttgtaggtctctgggatcatttctgtaacaaacattaggcccttggttagaaacatagctctctctcacacacacacatcgatcatctccaccaaaaccaatattttgacttatggtgcctttgctgctgtcagctcaaaaactacctgtactttgtttccttgaatcgttatgcttttgcatagccatcctctagcagttttatcaaagcaggacataattgcctacactctggaaatgaggggtgagtcacctttttcaaaattaaatttttaaaattctgacccctatcgccttccatacctttaatgtagagagtgcctattcagagcattccatttttaagtaatcacatccaaacaggtcacactacccatgtgtgtttcttcatgctataaatacgtttctggaaatgtttggtagaaacagatttcttttcttttttcggtgggtcaatggagtgacatttcaccactgacataatttcagctattcttttctatctccaatctggtgtggttcttgacacttgggcctacaattttttttctgcaccagcctttgtcagataatcagtgatcctaacacaagtgctccacacgagggaactaccctccatgggaactagcagtttgaagccctggtttcttgcctgagactctttgcaagtcacatggggaagaaggcagctcctcacaggctctggctgtgtgtggtgatgcagagctggctgtggggcttagggagtggggagccctctccttgctctgtccaggctcactaaggaccctgaactcagttaaaatacttagaaatttccccccactttgtccaaggaagaaaataatgtcaccagaacctgcttctttgaaaatcaaaacggcttctttgaaaatcaaaatgacttcttgtatggtctgaaaaaagaagactttggcattcacttacctgtggggtgattggaaaccctgaaatcctgtagcaaagtctacaactgccccaactgcactgactatcatgggcctgactgccaatttgatctatcctcataaagaagacacaatctcagtcagaatgcaggaccagtatctgcttagtttccagctgtaggtgctcagaaggatcaagaatggacactaaataacacttcatgcccaactgacaccttcattctgggtctcctggaccccaggacctgtaaaggaaggggtgacatgacgccttcattataaagtgggagtgtttgtactctcagtacctagtcacttctaaagcagaagggagcaattggctgggaaacctaagaatggaattcataggttttttcctggtcattgtgtctgctagctcacagggaaacacactgtataggtgaccatgagaatggccttcagactaaccatcagtaggtatttctaattgtaactactgatgggagagttccagttgaacatcgcagaaagaaaccctcacttgacatgcacatctttcaagtatcaaaacacctgttcagatccctattgaaagggagacaggatgactactcattttgtgtctgcaggtgtttcccacatgtctccaaggctcacccaattaatccattttgtcaaaatcctcagaggaagtatgaggtagaggaatgagcttgcaattggcagcctgaacaactctattctctaagctggactctgggtcttggctttgtgagtaatcttgggcaaagtgttccctcctctagttctcagtgttcttttcttcaaagtggcatcaacagtctcttccaggcctatcttccaaggtctttcggagaagacacgagacgatgcgtgggaaaaggccaagagcagcagaatacctggctacaggtagctgcttaattgcaatatccttagagccaccagtgtcatctgatatacttatctcagagcctgagatccattgcccctgtcacttgtctttctttgggtattgaaatgactagtctgctgaagtctgtggagtaagattctgccaccattgctgggcttgatctcctcaactgtcttcagaggctggaacaagatggtctccagaggcccctttgctaggataatttatcattctcattgaagcacaggagagaagtcagaatttcaggtattggagtcaaacgataaaatcctgttggtggcaacactcactccaatctttgctccaataggacagaggggaggctagattctctcagagccccctccggaaggcaactgcttccttcttttcttccttcaatgtataaacaggtcttctttcctaaaggttctggccaagaccttgaaaactacacattctctcttggttttgacctgtgttgaccatcagtgtgtttttagtggacaaaaaaaaaaaaaaaagaaaaaactcaaactgagccccaagcttccctgtttcacacatggcacaagcccgcacctctcatactttggattgcctttcatccgtccactcctgttttgtgctctggagagcctgtgtcttctgctcatccacttggacatagtctactctttgttcttctgaaaggagaagtttctgaaggaggagaacaaaaaggttttcattacatctaacttaaaatgtcaggaaaatgtttacccttttgtattaaattgttaaatatttgttgccctttcctctgtgtggaaactttgtactttgtatgtgtgcttgtgtgtgtgcacgcacgtgcttctgcttccctcaactttgctctagccacttgacttgctttgatcaatataatgtaagtggaagtgacatggcctggcatggcggcacgtgcctgtaatcccagcactttgagaggctgggatgtggtttggctgtgcccccactcaaatctcatcttgaattgtagttcccataatccccatgtgccctgggaaggacctggtgggaggtaattgaatcaaggggatagttaccctcatgctgttctcatgatagtaagttctcaagagatctgatagttttataaggggctttccccatttcattctgcacttctctttcctgccgccatgtgaaaaaggatgtgtttccttccccttccaccatgattgtaagtttcttgaggcttccccagccacgctgaattgtgagtcaattaaacctctttcctttataaattacccagtctcaggtatttcttcatagcagtgtgagaatggactaatacagaggccaaggcaggaggatcacttgagcccaggagatcaagatcattttttattaaaaaataaaaaacagccgtgggtgatgatgtgcaactgtagtaccagctacttgggaggctgagatgggaggataactttagcccaggagatcgaggctgcagtgagctatgaccatgccactgcactccagcctgagtgacagagtgagatcttgactcaagaaaacaaaacaataataacaaaaaggaagtgacatgttccaatcctaaggagaaagaggtattctgtgattctgcaatctctctttttcctctgccaggaggccagcacacttcagatgggggctgcttctcttgcctcggccctggactggagatgacctggaacacaaaggctctggcctgcaataaaagagcctttgtgttgaaagcagatgagatttgggggttgtttgtctaccaaaactgactaatgctccttttatacttattgctcccacccttcttaccagcttttctccagtctcatatcagatttttggaacgatattaaaagtagaaaacaagtaggagttacctcagcaaaagaggaggaaagtcctcagttgtttcccatgcactcattccttacgctgtacagtgggtgatactagttcacagatatgataacttacatgtattaactcaattaatcctcacaacagcccttgacataagtgttgtcatttctgattcccatttttcagatgagaattctacccaaaggggtagctgcccaactcagcattcaaggccccttacttccaacttacagttctttccactgctccctcaagtctaaccaaactagactattacttgttccctaaacaggatgttcctacacctggagggtcctctacccgaccctcatttctgcctgagatatttttctataaactttttggtccaaattttgaagtgtgaatatcacatctatttatacatacacacacaaagaacacaccctagaaggaaatacaccaagatttcattctctctgggaggcaggatgagggccgattttaatattcttcattatacatgtctgcatttttaacactttctaaggagaatatgcatggtttgataatcagaaaagtctaggcagagatggaatcacctgggaattcttagacacaaagcccttcctacctgctgcatgggggctggtgatgctgaattgaagtccagggccaaataatctaggctgaatttctttgtccacgtaagggcaccactgctcagggaactggctgttcggtgctcctcctaggaaccaacatcacaggagtcaggttaatgatgtctatcttggttgctcaagggaaggagggcaagttgtggcttcacccaagcagctgccatcagatcgtaacagaatagtctgatgagacctgagtcaatcagcctgcatatctgagtgagaactgtaatttcaaacagaatatagccaatttggccttcgcaatgaaaccataccattattcaccatgggaacagtttgccaaaattcactcaaaaaggaatttgcttcacgaatctgacaggcctgtgatacttcagagattaaaccctgacaagatcaactatacttattaaagttctcgtgaaggcatcccaaatgcacttaaatatagtttgcacaatacaaacagttataacacagatgaaaatcagggcccagcttcagaagtgcaatgctaccaatccatatctttgaagctgtttcccctgtaccatctttccttctcctcccaagaggtaaagcactatcttgaattttgtgcttaccactccttttacttttaaatatagttttatgagtatgcaagtatccttaaataacagactatttcattttgcctgtttttgaatgtcatatcaacagaatcacattgtatgcattttgggcggcttcagttttgtgttcaatattaggtactccacattcacttgtgtcgaagcattagccctatttcactcatttgcagtgggtcagatattccattgcatgacttatttaatcattctgccatcaaaggatatttgagttgctcccagtttgggggctattgtaagcaatgctgccatgggcattcatgcacctgtgggagaaattctagggcatttacttgggaatagaatcactgggttataggatatgagtatcttcaactttactaaatatcaccaaactattttccagagtgaaccaatctacacgtgtaccaggagtgtataagaatttctattgcttcccatcctggccaacacttggtattgtcagagtttttaacatttttcctacctgagacaggtaaaatggtatcttactgtggtttgattttccattcccctgattattaattagtatgagcacctgttcatatgttgaaaggtcatttgtttatttctcctctgtgaattgcctgtttgggtttgttttgttttttgggttttttttttgccttgtttctggttaatttttgtattgaattatttgtatatttttcttacttacccttagtactttttcctctgccctggagagtaatcatttgctatcatgtatgttgcagatagctcatcacagtctagcttcttgtcttttcatttctttttatggtatttcttttgactaagaaatacttttaatgtaatgtcgatcttttcctgtatggcttacattatgtttaaggaatccttccctatgctgaggtcataatttatttctctatatttttcctgaaattataatgttttgcaataatttgcttcacgtttaagcaataatctcacttgaatggattttaatattgtatatggtggtgcaatagaaataaaattcattccatttttgttgttgtttttactcaacatggataacctggtttcccccagaatgtcttgcgtgatcttgacccttttagaatcagcttcaaagttcctcaaaaatctctgttagggaattggttagataatgtctttaatatttgagtcttcctattcaggaacatggtctacttttccacttatttcattctccttaatgtctttcaataagttttaataattttctccacaatattttttgttaggtttatcgctaaatgcctagagtttgttgttactgtaaatggtaagttttgtttaaattcttttttctgtttgttaccattatctagacagtgaactggattgtgtatattgattttatatccatcaatcttgatatcttttattaattgtaattatttattttactaacttagtaattctaattatttctaagtagattatttcgagttatcattcatataagcagattattttgagttatcgcttcatctaagaataatcactctttgtcttcttccttcctttccaattcttattcattttgtttctttaggagatgtttttagcttttaaccactgagtatgatatctactacaggttctataagattcatttttcatttgttatgaggttagagaaaattcctctattccttgtttactaatagattttttcatgaatagatgttgagttctatcaaatgctttttctgcatctagtaagataatatatcatttttctcctttaatctgttaatgtgcttggttgacttaatagatattcctggtttatggttgtaatagctcatctctctgagaatattggtaataatagagttttaaaaaggcttttcctagctgggcgcagtggctcacacctttaatcccagcactttgggaggccgaggcgagcggatcacttggggtcaggagttcaagaccagcctggccaacatggtgaaactctgtctctactaaaaatacaaaaatctgccaggcatggtggcgcatgcctgtagtcccagctacttcggaggctgaggcaggagaattgcttgaacccgggaggcagaggttgcagtgagctgagattgcaccactgcactccagcctgggtgaaagagtgagactccgcctcacaaaaaaataaaataataaataaataaaaagacttttccttctggcatagttcttatttcctccaatctgttttgatttcaatctttcatgctagagttctcctgaaatgtcacatgaaatcactgactgttgcttatacttacgagcgaaagaccaaaaagctaacgtggagctttgtgtacatggatggtgtttgtcagctctggagttttctgcagggtgatcccattgggtggttatcttgagtaacccccaatattaggaactacgttttgccacttgggctgctcaaatagcccagagaaatattttctaatctccaaactcaattgtaatggtctggttgtcaacattctggaaaagggcttgagaatggttctcatatccattatgcctatttacttaatcaccttgtcgttagtatagtattcgtggtcaaatatgtctagtatcccccagtgcagagaccttttgttttactctctccagagagactgaacttcaacttttctatgagatgggggatggaaagtcacagtgtttcacctccatggagtgagggaagggatcttggaatttacctgatgcctttgaccattactgcttcttttactttcccttcaaccctacttcagaactacctactgtggacaattcctgaactctttgggtagtctgcagtataagtcaagttgcttcttgccttccttccaccacatttaagatttaatttttttgtgggggggaggggtcttgtaagtcatttactacatatctacctgcattctagtttccaatatgttactgctattttcttctccaattcttcatatctttgtgggtttatgcctttaacagatttctttactgttattttagagggtgtttggggatggagagaaattggaagcttgcggtcaatcttccatttgaggttcatgtgtcagcactttatttctttttgtggctgcataatacaatggaatattatactacattttattatatattatactacattttattcacacattcatcagtcgatgatcatttgagttgttttccctttctggctattatgaaaaaatgcttctatgaacatttgtgtacgagtatttggttagacatattcttctttgggattttaaaatccgcatccaccagtaacattggcctacagctttctacttatgtaattgctatttgttttatcaaattattttagcctcataaagtaaggtgggtaatattctcttctcccattcctggtaggtgtttatataagattgcacttatctcttctttttggtcgaaactatctgtaaagttttttgggccttatgatcctttgtagtacaaattttcctactgattcagtgtctttaataggtacataaacattcaggttttctaattctacttgagtcaatttctgatttttttttaatccagagaatttgcctatcacaaaagttttcaaatttattggtacagagttgttcacaaaattctcttaggtagttaatctctcatgtatttgtaattattatctgttcttcattcttaatattacttatttgtattcatatcttttgtattagttttgttaaattttagtctttttaaagagccaattacagctgtattgatcctctctgattttgttattttgttagtttctgcttttgcctttattctttcacttttgtagggtttttctaaacttattattataaaatttttccagcaatcagccaaattaaagaaaatatacccaccatgtatactccactaacattttattatactaacctgcttgtaagtctttgggcttgtggaggaatggtacctttcatgaactgtgagcaactctagcattatcccttgacatattgcctctctcctatggttctataatcttcttcagcaactctgactatacaaatatttgaccttcttattctatcttccatgtcccaaatttctttcatattctccatgtttttaactcctcgttctgatttattagtaacttattcataaattatcttccagctcactaaatcactctttgtgcttagtctgtttatctcatccattgagtttctaatttcattcttgtttttatttctacaagttgtaaatggtcttttacaatctacttggccatttttaatagtatctcattacttaatccaactttcaatttctcatttatttctttaaatatagtaaaactacttattttatattcaaaatccagtgtttccaaaaactgcctacttccatatttgattctattgtttgtaattcttattaatttggggggttgctgtttctcaatatttttggccccagagatttcttttcccttcccttcttgtcagctgagttttagacttaaaaatgtatcatatttataataagaggtgtttttcatgctatcttgcctaccaaagtgttccatcaaattttaaaaatagaataaatgtagtttcacctccagtaatgttgaataaagtaattttgatcacccttcctgctgagaacaatatttttttccttttttggtagaaattaaaaaattgtttctaaaatttttatgggagtagaaaagtcaaagaaaaaaaacaaaaaaaacctagaggaaggtaaacaaagcaggacttactttccttgatattgagtcttataaagctacagcaactaagggagtttgtattgttcaaagatagacagggaaaccaacagaatagaattaagagtccataaaaaacccgtacatatatggatatttgatttatggcaaagatggcactgccgaattgtcagtaaatgatagtcattttacataaatggtgccaaccaattagataaacatatggggaaaaatgagtcttgacccctatctcacagcacacacaagttaattcaaggtggtataatccaaatgtgaaggtaaaactagaaaactcctaggaaataaccataattcacccgagatcaaatagataatgatcctgtattaaagaaattgaattcacccagagggtttcactggtgaattataccaaaaatttaaagaataaacaaaactaattctacacgatctgttccagaaactagaagaggagagaacacttcctgaggagcccggcatgaccttaataccaaaaccacacaaagacactacaaaaacctaaagatcaacacccattaggaacacagacatgaaaatcctcaacaaaatattagcagatgaaatgcagcaatatatacaaggaaataatacaccatgaccaaatggggtttatctagagaatacaagactggcttaaagcctggtacagtggctcatgcctataatcccagcattttaggaggctgaggtgggaggatggcttgagctcagaagttcaagaccagcctgggcaacatagtaagaccctgtctctaccaaaaaaaaaaaaaaatcccaagaaatctgaggaaaataaaaacctcctataattaataagttaattcagcaatctcaaactcttgggctcaagggatcttcctgtctcagcctcctgattagctgggactataggcacagctactatgcatggttaatttttaataacatttttgtagagacagggtctcactttgttgcccaggctggtcttgaactcttgggctcaagccattctcccacatcagcctccacaaagtcctgggattacaggtgcgagccactgaactcagccaatcatatttctatataccaccaatgggtcattggaagctgaaatttaaaaaatactatttataatagttccaaaaatgaaatacttagatataaatctaataggacacacataagatctatgtaaaaattacaaaattatgaggggaaaaaaatcaaagaaaatctgaataaatgagccaggcgcgatggctcatgcctgtattcccagcactttgggaggctgaggcagacggatcacttgaggtcgggggttcgagaccagcctggccaacatggtgaatccctgtctctactaaaaatacaaaaaagtaagccaggcatggtggcgtgtgcctgtaatcccagctacttgggtggctaagacatgacaatcacttgaacccgagaaggggaggttgcagtgagtcgagattgtgccactgcactccaacctgggtgacagagcaagactctatctcaaaaaaaagaaaaaaacaaaacaaaaaaaacaaaaaccaatctgagtaaatggaaagatatactgtgctcagtaattggaagattcagaatagtaaagactcaattctcaaatgtatgtatagatttaatgcaattccaactaaaaaaaaaagtgttaggccaggcgtggtggctcacgcctgtaatcccagcactttgggaggctgaggcgggcggatcacaaggtcaggagatcaagaccatcctggctaacacggtgaaaccccgtctctactaaaaaagatacaaaaatttagccaggtgtggtggcgggcgcctgtagtcccagctactcaggaagctgaggcaggagaacagcatgaacctggggggcggagcttgcagtgagccgagatggcgccactgcactccagcctgggtgacagagcgagactctgtctcaaaaaaaaaaaaaaaaaaaaaaagtcttagcaggatatttttgtagataaagaacatctgactctaattatacatggaaaggcaaaggaagtagaataacaaaaacaagttttaaaaacaagaatgatgttagagaaaataaacttcctgattttaaaatttactccaaagctacaataatcaagactgtatggcataggcaaagagacaatggaacagaatagaaaatctacacaaatatgtccaactgatttattacagaggtgcaaagaaaattcaatgaagaaaggattatattttccataaatggtactgaaacatttggacatccatatgcaaaatgtcagcttcgacttcacctcacatctcatacaaaaataaacttaaaatggatcatagacctaaatgtaaaaccataattcttttagaaggaaataaaggagaaaattctaatgaactaaggttaggcagagttcttagacataacaatccattaaggaaacaaaatcaataaattggacttaattaaatttttaaatgtttgctctgcaaaagacagaagagaatggaaagacaagctccagatacggagaaaatatttgcaaactatatatccattggaggacttgggttttttttgttttgtttttgttttttttttttgagacagagtcttactctgtcacccaggctggagtgcagtggcatgatcttggcccactgcaacctctgcctcccgggttcaagcaattctcctgcctctgcctcccgagtagctaggactacaggcacgtgctaccaagcccagctaatttttgtatttttagtagagacagggtttcaccatgttggccaggctggtctcgaactcctgccctcagatgatcctcccacctcagcctcccaaagtgctgggactacaggcgtgagccaccatggctggcccctttggaggacttgtacacagaatatataaagaactctcaaaactcaatgtaagaaaacaaacaacctgatttaaaaattggcaaaaagattgaacagatactccaccaaagaaaatatatggatggcaagtaaacacaccaaaatatgtccaacataatttaccattaggaaagtacatgttagagccacactgagataccaatatacatccatcagaaggtagaaaatttaaaaatctagtaataccagaggtacaaggaggagctggtaccattccttctgaaactattccaattaatagaaaaagagggaatcctccctaactcattttatgaggccagcatcatcctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcagtaaatgtaatccagcatataaacagaaccaaagacaaaaaccacatgattatctcaatagatgcagaaaaggcctttgacaaaattcaacagcccttcatgctaaaatctctcaataaattaggtattgatgggacgtatctcaaaataataagagctatctatgacaaacccacagccaatatcatactgaatgggcaaaaactggaagcattccctttgaaaactggtacaagacagggatgccctctctcaccactcctattcaacatagtgttggaagttcttgccagggcagttaggcaggagaaggaaataaaggctattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccaacaacagacaaacggagagccaaatcatgagtgaactcccattcacaactgcttcaaagagaataaaatacctaggaatccaacttacaagggatatgaaggacctcttcagggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgccaagtcaatcctgagccaaaagaacaaagctggaggcatcacactacctgacttcaaactgtactacaaagctacagtaaccaaaacagcatggtactggtaccaaaacagagatatagatcaatggaacagaacagagccctcagaaacaacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaagcgttagacctaaaaccataaaagccctagaagaaaacctaggcattaccattcaggacacaggcatgggcaaggacttcatgtctaaaacaccaaaagcaatggcaaccaaagccaaaattgacaaatcggaactaattaaactaaagagcttctgcacagcaaaagaaactaccatcagagtgaacaggcaacctacaaaatgggagaaaactttcgcaacctactcatctgacaatgggctaatatccagaatctacaaagaactcaaacaaatttacaaggaaaaaacaaacaaccccatcaaaaaatgggcaaaggacatgaacagacacttcgcaaaagaagatatttatgcagctaaaaaacacatgaaaaaatgctcaccatcactggccatcagagaaatgcaaatcaaaaccacaatgagataccatctcacaccagttagaatggcaatcattaaaaagtcaggaaacaataggtgctggagaggatgtggagaaataggaacacttttacactgttggtgggactgtaaactagttcaaccattgtggaagtcagtgtggcgattcctcagggatctagaactagaaataccatttgacccagtgatcccattactgggtatatacccaaaggactataaatcatgctgctataaagacacatgcacacgtatgtttattgcagcattattcacaatagcaaagacttggaaccaagccaaatgtccaacaatgacagactggattaagaaaatgtggcacatatacgccatggaacactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacttcacactctggggactgttgtggggtggggggaggggggagggatagcattgggagatatacctaatgctagatgatgagttagtgggtgcagcgcaccagcatggcacatgtatacatatgtaactaacctgcacattgtgcacatgtaccctaaaacttaaagtataataataataaataaataaaaaagaaaaaaaagaacaaaatacttaggaataaatttaaccaaggaggcaaagacttatacattgaaaactgtaagaaagaaagtaaaggagacataagtaaatgaaaagatatctgtgttcatgaattgaaagacttaatattgttaacatgataatattatgcaaaacggtttgcagattcaaagcattccccatcagaattccaatggtctttttttgcagaaataaaaaaccctgtccttaaagttcacgtgtaatattaagtgacccttaaatgacaaatcaatcataaaaaagaagaacaaagttggaagactcatactttctgatttcaaagcttactacaaagctacactaatcaaaacattgtggtactggcataaggatagacatatagaccaagaaataaacccttgcatatattgattttcaacgagattttcaatgagagcgccaggaccattcgacatggaaaggatagtctagactttccaacaaatggtgctgggaaaactgaatgtccacaagcaaaagaatgacgttggcctctaactttataccacatacaaaaattaactcaaaaaagatcaaagatctaaacataagagctaaaactataaaacttttagaagaaaacataggagagaatcttcatgacattggatttggcaatgatttcatggatatgacgccaaaagcaaggcaataaaaggaaagaaaattttgacttcatcaaaataaaaaacttctgcgcatcaaaggacactatcaagagaatgaaaagacaacccacagaatgagagaaaatatttggaaatcatgtatctgataaggggttaacatccagaatatattttaaaaattcctataactcaacaacaaaaaaagaaacaacctaacttaaaaatatgcaaaggacttgaatagacagttctccaaagaagatatataaatggccaataagtacataaaaagatgttcattaatcattagggaaatgcaaatgaaaaccacaatgagataccaattcacacccgttaggatacccattataaaaaatgataaataggtcgggtgtgatggctcacgcctgtaatctcagcactttgggagtccaaggcaggcggatcacatgaggtcaggagttcgagaccagccttgccaacatggtgaaaccccatctctactaaaaatgcaaaaattagccgggcatggtggtacacgcctgtaattccagctactcaggaggctgaggcaggaggattgcttgaacctgggaggcagaggttgcagtgagccgagcttgcgccactgcactccagcctgggcaacagagcgagactctgtctccaaaaaaaaagataaataaaaattgttagtgaggatgtggagaaattggaacccttgtgcgttactggcagtaatgtaaaatggtgcagtcactgtggaaaacaagtttggtggttccttaaaaagttaagcatagaattaccatatgatccagaaattccacttctacatatatatatacaaacaaattgaaagcaggaagtcaagcatacacttgtatgccaatgtttatagcagcattattcataatagacaatggtaggaacaaccctaaatgcccattagcagatgaatggatgaacaaaatgtggtcagccttaaaaagaaatgaaattctgttggatcctacaatatggatgaatcttgaaaacactagatgaaatgaaagaagacaaacacaaaaggacaaatattgtatgacttcacttatatgaggtacctagaacaggtaagttcatagagacagaaagtagagctttactacaagaaaaatatttttcaaaaactgtaaaagaaagcatctaacagttctaattgcctaaaaacttgaaaaaaatccaaatgtcttccatgggtgaggggacaaacaagatatgacacatccatatgcttgaacactgctcagcaataaaatggaaagagctgttaatacatgtaacaatggatgaatttcaaaaaaaccattctgagtgaaagaagccagttttaaaaggtaccgtatgattctatttttgtggcattcttgaaaggacaatactatagtcatgaagaacagatcaatggttgctaggggttacaggtgaagggaggatgtggctctaaagaggtagcatgagggattttggaaccgttgtgtactctgatcatggtggtggttacgcaaatctctatatatgttcaaactcatagaactgcacaccaagagaaagtcaatttcactgtatgatgtaaaaatgatctaaaaatgtaaaagtattgtaataccataatcaaaaaattaatgtgagatttaagaggctagaactctactataaaagccttacaaagctgttgaaatcaaagggcttgaaaaagtgatagagaagaaatcccatataataaaattatgtttattcttctaaattttctataatttcacaaacatttaaagaaggatatatggcaaaacttgtatttcagtaaagcaaaaccgtgtttcagcccctggccttaatcactacattcagatcagaacttgcccttaaagagaaaaaaaaaaattaacatatatacttatgcacaaaatcaaagtcaaatcatactaggtttgactaccatattgggctgttatgtggcacaagtgaaataacgtaaatcaaagtcatgtgaaactgtcttattactaaagtttaaaaaaacacaattgaacaagatgggatagcctttaaacatttttatacgacagttcccagatcatagctactatcagccagtgttctgggttcttaatctgctgtgtcatgttgcctactaatacacagagacagtcattgatcagtgattataaacctaggtaaacaaacgattcttagctttgttgttaatgaaacactgatctttctctgtttttttttttttgagacagagtctggctctgtcgcccaggctggagtgcagtggcgttatctcgactcactgcaagctctgcctcccgggttcctgccattctcctgcctcagcctcccaagtagctgggactacaggcgcccgccaccacgcctggctaattttttgtattttgtatttttagtagagaaggggtttcaccgtgttagccaggatggtctcgatctcctgaccttgtgatccgcccgcctcagcctcccaaagtgctgggattacaggcgtgagccaccgcgcccagccaacactgatctttctcacaacatcaaagatcagaaatgaactgttggtatctggaatgactctgtacttgcttccattgggttttagattcacttcctttttctgttctctggagacagagcacagctgttaagcatcgttttataagagtgttttcttctagaaatttcccaagggccattactaagtgtcagaaatattgggaagaccataacagatttgtatatgagtcactttgcatctgcatacggttaagtgcacttacagcatgatttgaataaaataagaaggtaaaatgaagcatttaattatagcttaactggagattactatttttagattttcagttgctgattatccttgcatataggaaggcagaattgtcttctcaagagtatattgtcacagagccttgaacattgtccttctaagatctcttttcaaaatttcgtagttcaaacagaagctctctcttgagttccctacatttctaaattgcagaacaggcactgtcatggctaaagtgtctgctaattgccagaggtgctaaaagttcctctccatcttcaaaaagcccatgttctcaatagcatccaagatgaagagaatagaaggaacaacaggctagaagggaaacatcaggactctttaactgcaaatggttaatcaagtctccatccactcaggtctatagaaagacccataataggaatcttccagaggctaagatacactcacagtccagggcactgtacctttcccaatgggactctaagtgattcatcctccaggaaggttcagaagcagtcaggacagggccaccaggtgttctggtggaagggaccatgtaatatgttgagtttttacaatttgaactctggacatccagagaactacaaacctattggggtcaaacaggacatcacagccttggtgaaaagaattgctggcatttccattttcaaattaagcaagcctcagccctgagctatcttgaaatactgcaatctcaaaatggtatgaggagttgaatgttgcaggaaagaaagccaacttcaaattgatttgttccaagtctagaaaagcttgtggcctggttttacgatcaagtggttgttttaaaattgcacagggcttactgaaggatgtgtttcctttacaatgagctcataagactacagattggggtgaaggataagaagagtgtgaaaaatataagattaccatttcgatgtagctttcttcgtcttctctggaaacaggattagcaaaaaatcttgcagaattaataccatttctttctggagagagaaagctggttcgactgctaagaataaaaatatagatgaggtcaaagcaatgtcttacagctgctctgaaagctggccaggaactaacatggccctcatggggtttcagccctcctcttccagacacaacttccttccggccaaagcaattcctgaagaggcacaaaatgcccaacagtttctgctccactttggggcaaatggctcccaattcacaaaggctgctttttctcaggccctctatgtgacacagctcatgagctttctaaacggacgagggcatcatatcatttagcaaaaaaaaaaaaaaaaaaaaaaaatactcctttggggccttcttgtttctattcaatgtaaggaaaagtgaggaagtatggccattcctctgataggacacaagactgccaatcaactcccatccttctcctgagtcagaagcatgagctgagtcacagtcttggctggaaatacagctcattgcagaattctgctttacaatgcaattgtgttttgtggcatttagagtgaaccgagaaactcctgagccaagctcaggactaaaaatgcaacttctaaaaggtgagatgaaagggtgcaattacattttgaagtctgtctacccagcccgtgaacctgggaactcccttgtcctaccccattcacaaagttgggcttgggccatagccagttccactgagactggggaacacaattctctctccccaggaaatctgaattggcactgaaaaagagcccatctgttggtactggagttgtagcatgcaaacaagttcagggggtatggtacagctatctttgaccatgaggattgtgcaatagaaaagaatactgcaaagacaaaggaatgcacagatgtgaagagtgaagcagaagtgagtagattccttgggttcccaacagcacactagttcctgattccaggatcctgggagacccagacatattccttcctttgtgatccataaaacagctcttgctctcgataataaacctcacccctcctttggcttaagctagatcagatgggcttcaactacatttaatcagaggcctaacacacaccggggtgtctgtgctggatgaggctcttttgagcaatcagtcttaccaaggcacagtgcgggtcctggtaagagatgcatgttcccggatgatcgagaggtttctcaggtccagaggaggtggccgtgctacaagacagtgtgcaacatccaggaggtcaaggccagagtctaaagactgtaaaactatgacatttcactttcccagcacaccaaatccacatttactaacaggcagcactgatgatgagggtgaatttcactgtcctcctcttccctgcctcactgggagtaaagacaaatactgagcaaatggtcacattacctgctggaggtaacaacgtggcaaggcattattaagaagtctctgtatatcacgcgtgcttctaggtgtcgaaggcacaggatgaataaagcagatgaaagtctctgaccttgtggaattgcaacatctattacctcacacccgatgtgtctgaagtggaaatgttacctttcttatcacaggcagagatgatcacccaggtcctagtcttccccacctacaatccattgtccacctgatgatccttctgcctagaacattctatcccatctctttgcctctagacaagatcaggccccacagcctgggctctcaagttcttgtacttacccttcacagcacagccccagtttgtgataatacactcatctatgatttatctggacctaaactgtgctccaggagaataggggtgtatctggtttgttcactgcagtagtctcagcacctagaaaagcacttggtatctgccccaacccttattccacctcagtggcccatcttcttgagttagtcctggctcaggtatccacctttgcatccactcattaaatctccaaccctgagtctgtcagacatcttctgttgcctatcacaaggtcctgcagagctgcactgtccattgtcgtgacaactagccacacgtgcccatttagacatatatgtacatttattaaaattaaatacaatttaaaatgtagttcctcagtcacattagccaaatttcaagggttcaatagccattatctccaacatcacagaaagttctgttgttgtttaattgtttctgaccagaattaatggctatttcctctgaacctcataagacagggtctgttctcctatttagcactgatttcataattctatttcatggtccaggtggattttacatatcttcctccccctcagactgaagaaccctccttgctccctcatctttgtatcccacccagtgcccaccacagcaatacatatgcagcgcatgcattgtaaatgtataaatgtattttgactgaaatttaagggaatatgcctggagtagaccaggcatgagtaggggtcttagttggcagctttgggcacagccacctgaagtgactttttttgctttctaaagggcaaagagaagttggaatgcacgagagatcagtcattctaccaatgcttccttgtaatcacacagccaactgggaaggggaggatgagcaagaatgaagttaaaaagtcactctgacctgctcttcctctttccctcttttcctatctatctctctgtctgtctgtgctgcttagcaaaccagagaagctgcctgggagtaagacagaagctgcaaggcaccccgtgcacagaggagtcagcctgctcattgccaaaatcctcttctatccctgaatacctctgctgacgggcatgcacagaacgatgagtgataaactgcatgtgactgggtctgaccttcaggaattggtgtcaaaggctattcctgactgccttacagaggctggcactatgattacattcaagtgctgtctaatgaggagatgccaggtgggattccattctaatccaccatcacttattcctgggcctttgttagggaaacagccaaagacgagccctctggaatgaacttggctttgtcagctgtatttgcaaggccacagtgcctgtaagtctcctgactcctattatcatgacaatctggggcagcaaggtgccccagcccttcctattccaacccagccacttctttcctgaccttacactttccggccctctggggtggtttctctaggtcttcctttacagaaaccttttctatgcaaccaccggaaccttgctcccctacccctgtacagcaggcctggtcaagtgcttacatttcctctgaggcttgagatctctattcactgggggaggttccaggtttgcaggcagctcaggcaacgggcttgagatgcttcctgagttcattggaatgtagtcatcagggctgcagtggggtccaagaccagaggcaccagcctgggggctcatgggcacatagctgtcttcgatactggctgaagctgtggggtacatcggggagaacctgcatggctgcaaaagaatagatacagattgggaaccacagaccagtcatggaaactgctatcagagggcggccaaagctgtacatatggtttcagttccaaattatccaagtataactctgaacttcctcagcaaagtcagacaagcctctagctcaagttctgcctctggacttatcgttttagtataggcgataagtctccaagatctgacactggaagacagagggttatgagtttatgcaaatgctttaagcataaagtgatgccttaagtagctataccaagttgagcaagtgtctgaaccattagaaccaataaggcccttatagaacaccaagtcctgtagttcccaagcaagttcaagtcttcaggggagactggaagattcctcagagactcagagtgctgaatcttaaagatttcaagggaatatacatagatcaagctgtttttggtaaaattgatgcttaaaagaacctgaatgttgaacttaccaaattcaaactaagccgcttgtctcggtgtcttaaggattggccttctacatcagctgcaagaaataagccaaggtggtgagaaatgcagaacaatatcaactgaaactagagtccagagaggcagagaagcataacacaacagttgctattagagtctagctgggcagtcagaacacatttccccaacagatgaaaaatcagaccagattttgaagaagtttctagccaatggtttgagttctctctgtgaaataggaggagacatagcaagtaattaacaaattcttattgcatttattacataaatcttctgaactggaggcagaactggaggtttgaggagaggagagaggtttgaaatattccttgtaacgagcaggagaacagggtgaacagagaaacgattgccttgtggagcagcattaagggcccaattgaggtctgtgaccagaaaagctactcaggtagacgcatggagagaaaggacatttggagttatccaggattagaaactcatcagatggatgcaagaaacagtgtgatattaaaatttagaataatttagaccataagagtagatgaaactatctaggttgcaagtgttgagaaaaatacaaaactctagagaatcctaagactcaaagaactaagagataagtcagtgaagtatcttgagaaagagcaaccatagattaatgaggaaacttgggggtatggtgccatgaaagcctcaggaaggaaagaatggccaacagtgttgagtggtgcagagaagttcagcaagtgctcccagcatgtggtggccagagcaaagtggccctcagccctcagccctcaagagcttggaggtgtgaaaagtcaggaggcctctaagaaataaacttaaaattcgacaacatcttaaaatgcaaggacaactcccagctcggaaaagatgtgacagagactgatggaattaagcatatatattatatatacatatatgtgtatgtatatatgtatatatctatgcttacatatgtttaaagatgtacaagtactggttaaaaactactctgaagtcagactgtctagttataaatccctacaccaccatgtattagctgtatggcactagacaagttacttaccctctctatgtctcagtttcctatttgtaaagtgaagccaataatataacctatttcataggacttctggaaaggacatagaacactgcctagaacacagaaagtacttaataattcttagaaactattatggaataatttctcattgtgggacttgcatgtgtgagcacaagcccttaactccctttccactaccagacccttttaaagccatcaaataacataaatatagagaaaactctgaatcaaagacataggtataatccatgtgccagataatttaagagatttgtgacagatagaatgcagatgggatcagagtaaaggaaggcactttttctcttatatgacagcattcattgcaagcttcctgaaatgcccttgggccttaagggaacatgggcagacagtactccccatggcctggggtggtgatagctatggagtgaggctcctctgccttatattgggaaaaacctaaacactacacaagaaaactattagaactaatacacaaattcagtaaagttgcaggccacaaaatcaacatagaaaaatcagtagcatttctatatgccaacagtgaacaatctgtaaaagaaattaaaaagtaatcccatatacaatagccacacaaaaacttaaatacctaggaattaacttaaccaaagaagtgaaagacctctataatgaaaactatgagacaatattgagggaaattgaagagtacaccaaaaaatagaaaaatattccatgttcatgtactggaagaatcaacattatttaaatgtccatactacccaaagcaatctacagattcaatgcaatccctaccaaaatacctattaaagtcttcacagaaatagaaaaaaaatcctaaaatttgtatggaaccatgaaagacccagaatagccaaagctatcctaagcaaaaagaacaaaactggaagaatcacattacctgacttcaaattatactacagagctatggtaaccaaacagcatggtgctggcataaaaacagacacatagaccaatggaacagaatagggaactcagaaacaaatccacacacctacagtgaactcatttttgacaaaggtgccaagaacatacactgggaaaaagataggcacataaataaatggtgttgggaaaactggatatccatacacagaataattaaactaagacccctatctctcaccatatacaaaaatcaaatctaaatggattaaacacttaaatctaagacatcgaactataaaactactacaagaaaacattagggaaaaaacgctaaggcatcaaactataaaactactacaagaaaacattagggaaaatctcgaagacatttgcctggacaaaaaaattcttcagcagtacaccaaaagtacagacaaccaaagcaaaaatggacaaatgggatcacatgaacttgaaaaacttctgcacagcaaagaatacaatcaacagagtgaagagacaacccacagaatgggagaaaatatttgcaaactacccatctgacaagggattaataaacagaatatttaagaagctcaaacaactctataggaaaaaagtctaataatctgattaaaagatggaacaaagatttgaatacacatttctcaaaagaagacaaacatatgacaaacaggcatatgaaaaggtgctcaatgttactgatcatcagagaaatgcaaatcaaaactgtctcaaaagagacatacatgcagccaacaaggatacaaaaaagctcaacatcattgatcactaaagaaatgtaaatcaaaaccacaataacatgccatcccacaccagtcagaatggttattattaaaaagtcaaaaaataacagatgctggtgaggttgcagagaaaagggaatgcttataaactgtttttgggaatgtaaattagttcaaccattgtggaaaacagtgtggtgattcctcaaagacctaaaaacagaaataccactcaacccagcagtcccatcactggatatatactcaaaggaatataaatcattctaacataaagacacatgcacgcatatgttcatttcagcactattcacaatagcaaagacatggaatcaacctaaatgcccatcgatgacagattggataaagaaaatgtggtccatatacaccatggcatactatgcagccataaaaaataatgagatcatgtcctttgcaggaacatatacagagctggaggccactgttcttagcaaactaacgcaataacagaaaacccaataccacatgctctcacttataaaagtcagagctaaatgatgagaacacatggacacatagaggggagcaatagacactggggcctattggagggcagagaatggtaagagggaaaggatcagaaaaaataaccaatggatacgaggcttaatacctgggtgatgaaatagtcaacaaacccctatgacacaagtttacctatttaataaacctacacatgtacccctgaacttaaaacaaaagttaaaataaaaaatatatttaaaaactgcaatgagattatcatctcaccccagttaatatggcttatatccaaaagacaggcaataacaaatgcttgtgaggatgtggagaaaagggaacctttgtacactgttggcaggaatgtaaattagtacaaccactatggagaagtttggaggttcctcagaaaactaaaaatcgagctaccatagatccagcaatcccactgctgggtatataccccaaaggaaggaaatcagtgtatcaaagagatacctgcactcctatgtttgctgcagcagtattcgcagtagccaagatttggaagcaaccaaagtgcccatcgacagataaatagataaagaaaatgtggtacatatatacgatagagtactcttcagccataaaaaagaatgagatcccatcatttgcaacaacacggattgaactggaggtcattaaggaggttaagtgaaagaagccaggtacagaaagacaaatgtcacatgtcctcacttatttgtggaatctaaaaatcaaaacaattgaacttatgggcataaagagtggaagaatggttgccagaggctgggaaaggtagccagggtggggggctgtgggggaagtggggatggttaatagatacacaaattcattagacagaataagacctaatatttgaccacacaacagggtgactatagtcaataataacttaattgtacatttttaaataacaaaaagagtgtaattggattgtttgtaacatgaagaacaaatgcatgatgtgattatttcacattgtatgcctgtatcaaaacatctcatgtaccctgtaaatatatacgcctaccatgtacccacaaaaattaaaaagaaataagaaactataaaagcaagagcaaaccaaactgaaaaatagtataaggaaataaataataaagatcacatcagaactacagaaaaagttcgttcttcaaaaagataaacaaaatcaataaaccactagactaagtggtttagtcacttagtcagtaactagagtaagaaaaagcgaagaatgctcagataaataaaattagaactgaaaaaggaggcattacaatagttaccaaagaaatacaaacggttattagagattgttttgaacaattatacattaacaaatttgaaaacccagaggaaaaggataaattcctggacacgtaaaacctaccaagattgaatcagaaagaactagaaaacctgaacaaaccaataatgagtaatgagattgaatcaataataaaaaaaggtcttccaacaaagtaaagcccagaaacttgatggctttactgctgaattctaccaaacatttgaagaagaggtgacaccaatgcttctcaaactatcccccacaaaatgaagaagaggtgacaccaatgcttctcaaactatcccccacaaaatgaagagggaattccctctcattctacgagaccagcatcaccctgataccaaaaccagacaaggacacaagaaaaaaaagaaaactacaggccagtatctctgatgaacatagatgcaaaatcttcaacaaaataccaggtttagtacctaggttatgaaataatctgtacaacaaacccagtgacatgcatttccctatgtaacaaacctgcacatgtacccaaaacctaaaataaaagtttaaaaaattaaaaaattaaaaaatactagcaacctgagtcaaacaatacatcataaagataatacaccatgatcaagtgggattaatctcagagatgcaagaatgagacacatcacatcaacagaatcaaggataaaaaccatatgatcatctcaatagatgcataaaaagcatttgataaaattcaacatcccttcatgattaaaaaaactatcaacaaactaggcatataaggaacatacctcaaaataataaaggctatatatgacaaacccacagacaacatcatagagaatggggaaatgctgaaagcctttcctccaagaactagaagaagaaaagaatgcccactttcaccacttttattcaacatattactggaagtcctggccagagcaatcaggcaaaagaaagaaataaagatatccaaattggaaaagaggaagacaaattctctctatttgcacatgacataatattaaatacaggaaaatttaaagatgctaccaaaaaactcttagaactgataaatgaatttagtaagtttgcaggatacaaaatcaacatacaaaaatctgtagcatttctatacatcaaacaatgagctagctgaaaaagaaaggaagaaagcaatcccatttacaatagctacaaaaaatttcccagggataaatttaatgaaagaggtgaaagacctgtacaatgaaaactaaactacaaaacactgataaaaagaattgaagaggacacaaacaaatggaaagaagaattaatattcttctggatctggccgggcacagtggctcgcacctgtaatcctggcactttgggaggccgaggcaggcagatcaccttaggttgggagttcgagaccagcctgatcaatatggtgaaaccccatctctactaataatacaaaaattagctgggcatggtggggcatgcgtgtaatcccagctactcgggaggctgaggcaggagaatcgcttgaacctggaaggcagaggttgcagtgagccaagatcgcaccactgcactccagcctgggcgatagtgcaagactccatctcaaaaaaaaaaaaaatgctcatggatcagaagaattaacattgttaaaatgaacatgctatccaaagttatctacagatttaatgcactctctatcaaaatatcagtatatcaattacgttcttcacagaaatagaaaaaacaatcttaaaatgtatatggaaccacaaaagaccttgaacatccaaagcaatactgagcaaaaagaacaaatctgggctggacatagtggcttatgcctgtaatcccagtacgttgggaagctgaggtgggaggatcgcttgaggtcaggaggttgagatcagcctgggcaacatagcaagaccctgcctctaaaaaaaaaaattttttttcaaattagtcaagtgtggtggcgtgagcctgtagtcccagcagcttgggggactgaggtgggaggattatttaagcccagaagtttgaggctgtagtgatctatgatcacaccactgcactgaagcctgggtgacagaatgagaccttgtttctgaaaaaaaaaaaaaaaattagaaagaacaaagctggaggcatcaaactacgtcaattcaaaatatacaaaattacaataacccaaacagcatgatgatattggtatgaaaacagacacatagaccaatggaacagaatagagaacccagaaataaatccatattttatgacgtcagcataacatttttaccaaaaccaaagacgtcatgataaaagaaagttacaggacaatctccctcatgaacacagattttttttgaagttctaaacaaaatatgagcaaaacaaatctagtaatttataaaaaggataggtatcatgataaagttgggtttattccagaaatgccaaggttagtttagcactaaaaaaattatccagtgaatttcttgacattaacatgataaaaataatatgattataaagtgcttcaaccacaaaaaatgataattatattaggtaatgtttgttaattagcttgattttaatcattccatgatatagatgtatatcaaaacatcatattgtatcccataaatgtatacaattatttgtcagttaaaaataaaagaaatacatctattcatgactttagaaaataacagttagcaaagtagaaaatatgtgaatgactttaatctaatgaatgatatctacaatattccacagcaaaccacattgtaacggtgaaatattagaagctttctatctgagatcaggaatgatacaaggatccgtattgtcaccaggactattcagtaacgtcctggacttcttatcccatgcagtgacataagaaaaagtaatgaaaaatacaagggttgttaaagaaaaaacaaagctattattatttgcaggcaatataattatatgcaaagaaaagacaaaataatccatagttttaaaaagctggatataaaatcaaaatccaaaactcaatttaagttttcatacaacagcaaaaaacagttgacaataacataaaaaatagcaaatacacggaaatgtattaataagagatatgtaaaatttctacactaaaaactataaaacattatatacacaaattaaataaaatctacgttgtactggcataaaaacagatacataaaccaaaagaacagaatagagaggccagaaatacacccacatgtacatggtcaactatgctttgacaagagagcaaagaatacacaatggagaaaggagagtctcttcaataaattgtgttgggaaaactggatatccacacgcaaaagaatgaacttgggcccttttcttataccatatacaaaaaattaacttgaaatggattatagacttcaatctaaaatctaaaaccatttagcccctagaagaaaatatagggggaaagctcattgacattggtattgattgacaatgatattttggatatgattccaaatgcacaggcaaaaatagcaaaaataaacaagcggagctacatcaaactaacaagtgtctgctcagcaaaggaaacaatcaacaaaatgaaaaggcaacctagagaatgagagaaaatatttgcaaatcatataaaaggggttaacagtaaaaatatataaggaactcacataactgagtagcaaaaaaactaaatgacccaattttaaaatgggcaaagatccgaatagacatttctcaaatggccaacaggtatatgaaaaaatgctcgacatcactaaccatcatggaaatgcaaatcagaaccacacaaggtatcggcccacacctgtgaggatggctaatatcaaaaaagacaagaaatacaagtgttggagagcatgtagagaagagaacccttgtacactgttggtgggaatgtaaattggtatagccattatggaaaacagtatggaggttcctcagaaactaaaaatataactaccttatgatccagcaatctctcttctggatacatatccaaaagaaatgaaatcagtatgtcaaagagatacttgccctcctgtgtttgttgcagcactattcacaatagccacaacatgtgatatggtttggccctgtgtcccccacaaatctcatgttgaattgtaattcccaatgttggaagtagggcctggtgggaggtgattggatcatgggggtggtttctaatggttcagcaccatccccctagtgctgtcttgtgatagagctctcacgagatctggttgtttaaaagtgtgtagcacctcccccttcactctcttcctcctgctccagccatgtaagacatgcttccttcctctttgtcttcttccatgattgtaagtttcctgaggcctccctagccatgcttcctgtacagcctgtggaactgtgagtgagtcaattaaatctctttgctttataaattacccaaattacccagtctccggcagttttttttttttttttgagacgaagtcttgctctgtcgcccagactggagtgcagtggtgtgatcttggctcactgcaaactctgcctcccaggttcaagcgattctcctgcctcagcctcccgagtagctgggaccacaggcacccgccaccacactgggtaatttttgtatttttagtagagacagggttccaccatattggccaggctggtcttgaacctctaaccttgtgatctgcccgcccccgcctcccaaagtgctgggattacagtctgagccaccgcacccagcctcaaatagttctttagtccattctcatactgagaatggactaatacaacatgtagtcaatttgtgtccatcactggatgaatggataaaggatataatggatataaaaaatgtggtatatattcagaatggaatattactcagccttaaaaaggaatggtatcctgtcatttgtgacaacatgggtaaaccaggatgagattatgttcagtgaaatgagctgggcacagaaaaaaaaatactgcacgatttcacttatatgtggaatctaaaaaagtcaaactcatggcaatagtaaaatggtggttgtcagggactggggaatgcaggtaaatgagaatatgttggtcaaaaggtacaaactttcagtgataagtgaacaagtctgggggatccaatgtacagcatgggtggccatggatgtgttaattagtttgattgtaataatcagtacataatgcatatgcatatcaaatcatcatgttctgatgcatatgcattcacaccttgaatatgtgcaatctttatttgtcaattaaatattttaaaatacaaaaataagacctacagaaatggaagcatatttcctattcatggattggaaaattcaacattgtagtcaaatcttcacaaaccgatctacagatcggatgcaatcctcctcaaatccccaatatatttatatatgtgtgtctagaacctgaccagctgactgtaaaattgaccctagaatagccattatattcccaaaggcaggaggacttgtcctactggatattaagacagaatggtacagtaattaagagagtgtggcactggtgcaagctggacaagtaggctccaagggatagaaagcagaaaggaaactcagaccctcacatacatgggcacttcatctatggcagagggggcgctggagagccatggggacaggacagccttgcagggtcatcggatggagatccagatggacaaaaacgaaccttgacctcactctgccaccacgtaccaacacagattccaggcaaatctcagtgggaaaggcagaacaataaactttatgcattccctcagctttatcagagccattttgcttctaggcaccactgttgtttggtctttgtttcatggtcaaaacctctattttacttagttttaatctttgtttgccttcatgtaaaagaacacaacctaattgttttatgtttgtgttgaaatttcaaattatttcaagtttttgttcttcaatttaagacttttaattcattttcatatgttattattctactggttttattcatttcacttcctaaaatctgcttaaccactttcatttttccctttttgtcaactgttcacacatgttagcatatccagatcatttgtgtaatcagtatacatctatttcataaggactgtcaaaaggaagcaacatacataatggtaacatcattagggacattagggaaggtttttactagtgacttaattctcagtcagaatgagagattcgtacaatttgaaaataaatttgcactccttccactttccataattccttgaaaacatggcctaaataagtagtgatgtgtgggtgattatatttcaatggagagagaaagaaagagagagaagaaagaaaaaaggagaaagacacagagatagacaactagtttttgtgtctgtctgtgtatctgagagatacagactgatgtaagaaagaagagcaaaatgctaaggttggttggctcatggcagaaagatgaggtggctcagcaaagcagtaaagaagaggttactgaaaaaccacaatgaatgggcttgaattggctttcaccaaacagcttctgaaggccagagaggcccaggtggaaagaaacaggtggaggaagatggaactgcaagcagaattgcaagataacctcgtgaggataaatggccttatagaaaagggcaaaagagggctgtgggagggccctttgtacagccacttagaatttggaaagaacaagtctagtgggatgatgaatgaggttgatgggattgctaaaaaatagaaggcagtgatggtctgtggtctcaggactctctatgtatgtgagagagaggcaaagaagggaatgggactgagttaagacaaaagacatcaacttttgtaccaagtgggtccctgagtgactccaaaaaacactaggagctcagactcaggtgggaagcttaccacatgggcaaggacttgcatgggcaagcccatcacaagggaccagggttccaacctattgcagcatctatggggacctaaatgtctctcctggtggtcaggctcaaaggaggggttggggggatccaggaacagaagagtgctgctttcagggtatatgcttccaccaaggatccagccccattagaagatcaggccagcctgaacaagggacaagcacatatgtacacaagtacacactactgatgtggctttttaccaagctgcacacatcaaggtaattctaacccagccccatcgttttggtccattggcatgacctcacatgggcacaaagagtgaagaggagcccgggttttcttggcgcctgaatcttaggacccaacacttacctttccaggttctcatgttgtctaaaccagagagggagattcttcttggaaccagagtgcattctggcttcttgctaccactgtgtgtactccactcctcttggcgccgttcagacagatggcttggcttaggggggcggggaggtggagtgttggacataatgtctagttcttttgctccacagggtaaggaaccttgatttttatctacctgaatggtggaacttaaggaactttccagcaatggtgaagaagacaagtggtccctgggtggcccattgatttctctactccagatcagggcagcctgaggcctcgaggatggcacctcctgagctccactgccatggcatgaggggtggaccaaatgactggaggggagcggctgcaggcagtcaacaaaaacatcatcaaatgaagcctgttccaatgaacggtctgagtttgaccagctatcacatctggtgggtagactggggaagaaaagcatgtaagttggactaaaatgcagccatccacccaccacaaaaccaacgctggcctcattcccatctccccagtaccaccttgcttgctacttgcatagccacattccctctacaacactcagttacaccaaccccttggtgtggcaaaagaaaaatggtttgttgattttttcatcctctaagcatcagatacacatgaaaatgcaaggctagaagtgaaaaccacaatgctgaaaagcatgactcattctgtttagtatactacatgcttcatctttcacagtggttcatagcaatctgttcctgccttgacattggcaggaagagaggtgacagcagacacacccactagaaaatgctaccactaaatggactaatttggtgaagcacactgaacacatctcagctacggactgcaagaggaggcagtgtgactctagagagcatgctagcaggcccagctcagacagagtcctgggcataagcatacctggtatggtgcagtcttccagtctcgcagttggacaaaaccagataatctggaaggaagagaagctctgactcacttctggtttcctcagtggctacggcattagtgtttgggtcatctcttggcaaagaggagctggcagcatgggcggtaagaagggagctggcagaggatggctgcagggaggagggcgtgtaagagaggctctccatggaatctgctggagaaatcatttcccaggttaatgtttaagaatggctataacacgcactcaaaatttctccaacagcatcaaagaagccaaacagaagatgcaaatcacagctggtgtttgtactgatggagaagaccatttccccaagctataaacaatgtctgggaaagaaggccaatgtttcaagagcaaagtgttgaatcaattaagagtaaaaaacccagcattcttggcccaaaaatctgcagttaatctacgcacagcttctttatggccctcagcagcagccttgcctcattgttttttcactcaactaacaaacatatatatatatatatatatatatatatatatatatatatatatgcataacaagtacatgcatatagttatatatgtacttgtgcatatatgtatgtatacctatacatgtttattatataggtatatgtctatatagaatacctattacatctaccatgtgcccagaatgccactaaccctcaatacagccaagacaaagatcctgcccttattgaagtttagattctagcagagaagacagacaaataacacataaataaagagtcctgttcatcactgttataagtaaagggaaggaaagaaacacagtgctgtggtggctggaaaagtccatttctttttctcaaggagcataacattctccccatcacctgagaacatggtccttaagatgaatttgaatcaggaatcaatgagaactccagatcagaaacagccaatgaaaagcctgcttttatttcccttttgaaccaagttaatagtccaggattcctgagtcaggatgacccagaactaactaggttcaagtccaggctctactacatagccattactacatggcctgccttctccaagtttccttttctataaagtggagatagtaatcacacataggccatagaactgctgtggggatgagacaagttaatatacaaaagcatttcaacagagatcctggccagggtacacacacaatgtgttgactactatatggttgctggagacagaaccaaacactctgtgaaaagtcacaagaaagccctttgggtgtaattctcagatgaagaggaccctgctcttatgtggttctaaaaactgaggcggggggctacagagaatggaaagggtcataggtgagttttctggcttcctccaacttcatgccgggacaggctctccagtttcggcctggtgccttactcattcctggtgctcttgggttattgggaaacatattatatatgtatgttttaggataactcctggataaggaaagaaacagaggagatatataacacagtatacgacgatatacctagttaaggctgaaggtgcacaacagggtggtaaagagccagcagcaaggctggagaagttagttggtcagggaggttctgcttgatttgcataatgtcagactctagccagaacctacttaatgctgcttttccaattaagttttgtccattgtaccaaggataaagaacttgccatcacttcatttccttttatttgagtgctcccaatgctcagcaatattattgaatagcctcacttaatatgcttccctggttcatgaaacgaaaaggaatgtgttctcagaaagcacactcttgtgcctgtcctggagggagattcaattctgactctccattgccacctagcgttagagtgtggatatttcagtggcagatggtggaaaccatgcagtaactcttaaaatgttgaagcaactatagattacaggatttaggggcaaagttttgtctactagactaagaggctaaaagaaaccagattcaaaatctcatattttgaggaataggacatgttgcaataatgtcaggggctcaacaacaaaatccatgaagggaagttaattgtaaccctaggttacaatatacctggaaaattacataggatgagttgtgtgtgtgtgcgtgtgtgcgtgtgtgcgtgtggcagagagagagagagagagagagagagactctggggtactcttcatgggtcaattgctcccactgcccagaaatggcccagagcaaacttacaactaatttcctctgcagagaacttgagacatttggaggtatcaggaaatctttcttgcctacgataagtagccaagttctctctttctaccatttagtgatgaacaacccaataggcaccagaaatgctggagttccacaatattttgaagtatggcaatatttgatatttctagaaggtcatgagtgtcagcatcatgggaagacatcctcatccacatttgactttcactgtggctgaatgagagcaaagacatgaaggggttttaaagccattaaagtaacctgcaatgctcagtgtgctcatggactctgccttcccacatttggactgggtaaaagagggcaatttccagtattgtatttggtaggaacagttctgatataaattagcctgccaaaacaccctcaaggaggcaggcttggcatcttgaactgtttttctgcagtaaccctccagtcctgggataccccttagcacatgggagccccaactccgctcttacctgcaccatcctccaggtggccaaggttgcagacctgactgatgctgtgcacccacacctgcatttcttgctcagttttggccaccaggtagaatgtacgggaagtagtcttgacaatgaacacgaaattattctgaaattccttccgaacaaagctggggcccacatgcttccacactgcacactcgctgaggtctatcacccggatgggcttgctggagtgcttgttcctgtagtactccaagacatcggggttgccgctcatgcggcctcgccggaggacaaaccagcgcttgcgccaggcctgcagaaaggcaattcaataaggagttactggaccaatttctcttgtttctcaggctatgccaagaacccatgtcatgacaaggacagcaggaaggaaacaaatcagccattctaatgatgaaacgctttgtattacaggactagtgcccatcttcaagtccgctttattggatgattttaaggacgggtcaggattggagagtctagtaatgggattcacacccacagtttgaagggccagaattatacaatcattgaaattgatgcagcaaaggaatgtagtacaaatttaacatatgctgaagctttaaaagaatcttagcaataaagaactagaaggaagctttcttactattatgtatctcagttcaagagccaatatcatacattaaaatcagatgaaaatcacaaatgctcaccactgccccagtatcttccaacattgctatttaagttctacacaactggccaagaaggaaaatcatacacattggagaggaggagagaagattgccagtgtctgaaggtgacaaattgtcttccataaaacccccaatgatgattaaaacactaatagaattctcagagaattaactagcttggctagttacacttcctatgtaagagacccttgtctaagcgctttactgtaacccatttaatccctaaaactatactatgggaggggtaactattactatctccatcttatgtctgataaaattgaggttcagagagattaagtaatgtgctcaaggtcacatagctaaacaactgtaggaatgaatttgaactcaggttgggatggaaggatcggtaatggatgtgaagttaaaaaataaagagagagaggaagtgtagccagctctccagaaacatctgactgtaaagggggaaagctctggggtcaagggattttttaaagatgggagactcttaagcattcaccccctaagtcacagtgtttttcaaccagggatggtataattcctctcgggagcatctgaaaatatgtgggttttgcttgttataaaggctggagatggagtggggggtggggcatggcaggattggcctaaagctatcagtgcccctgttttgaaacactgtaaaaacaaaaaggaattttccttaatggaataggaatcttggaaagagccaagcctggaagtcagatgaacaggtaaagctcagtccatgctcagaaaagaaaagagaatgatattccacagaaaccagtgccaagatttgacaggtctctttttgtgccctgagaacaactgagaatgacctagggctccttggcttcccactcaccattgacttagaatttttgatgtagacagtaccatcttggctcagtacaaagaaagggtgcagatctctggcctggggaaagaggtatttacaattgaccaaagccctagggagtcccctggatctgtaaacctccctgccctctcatggagccagggggaaggaaatgtttgagttccttgtcttacatttaggtgccctttgttcatcgaagggccagataggccagcctgcatggatagcgtatccttactttctgcggtagggaactatggcattagccccagttgggaattgagcacagagaaggatgacggctgaccgcagggagatttatagctctgtggtttttctctcccatgcggtagcatgtgtgacagcaggaagtgtggggttctgccaggaggtacagcgacccctgggacaggaagtcttttgtatctctagcttcatttatgtgtgatactttttaagcccaccagctttgaccaagaggccagggaaaaaggaaaagacactatttggagtattctcagctccctccctgctcagagaacatgaatctgagatggcagagaatccaaagaagcactgacctccaattatgccttagaataaaaagcccttccaggactgaggcaaggggcagcaagcagaaggaaggcagtcactccatgtcaggttggggcaggtgaaccctggtttgctcctgcctttacagacagtataaagctttgaaaagaggtctggccatgagtcaaacaaggagaccatctcaggagacaaacaacgtggtgtgattaagtccatgtttttaagacaggaaaaataacagcatgtttgtatgctcgtgggggtgacccaagagggagagaaaaattgattcagtaaattcctgttgcaaaaacgtggcactggatgggagtagagccactaaacataagagaaggagctcaagttttgctgtggggtttgaaagtgggaaacctgggcttctggcatcaactgaggcaaacaggaacataaggcctagtccagggaaggggctcaggggatgagagaatgccatttgtgcctgctgaggaaagctttcatggggagggagcatggggtgctccaaactttccaaaagccactttggtgggggaaatgtaaagaggaactttgttgcacttcccaaaaatgattctaaaagaggaagtcaaactaagcacagaaacaagtttcacattaaccgctcttagtgttatggagacaatagatttcttatcttttaataacaatattggaagagaagtaacaccaagagtttatttgagtgcctactctgcactgtgcatcctgctagacaatgaagctagaaaaggggattagagctggtccctaaaagacctcactctctagctgggatagggagaagggtagaattatgatatgggtagatttcaactcagcgtagtgagcggtctagcagaagaatgaaccaggagtggtgggagtgcaatgggaagagtgacatgaagaagtttgggctttatccattcattcaacaattacctgttgatagcccactaatatgctggacactgtgcagatactggggaagatgaagtgagcaagccacatgccctgccactcacagtctcatgggcaacaagggagtgagcagatggataaacagacgattgcaatcagtgagataagtgctacgataaggcaaaaccaagatgctatgggaacaaacaaaagagacatctctctcagatcagttgtctggggaggcttccaggaagaagtggtgactaagctaaggctaaagtggggcaggaggaagcagcgtgcacaaaggcattaaggtggaaaggctcaaaactttgcgtaagtagttcagcagggctggaaggcaggcatgagggtggaaaggaaaaagaacagtcacacagtaacttaaataggacgtagcatagtcttgatgctgaatcatgcaaaatcgccagtgtgtcatcccttaggtttttaaatctctacataagagttttgattatgcaaaaacagaagtgaggtgttcttggagctctttgctaagtaggtaaaaccagaggccacatatagttctgttccaccaggcttacaggcttctggaaaatggaagacatgtgacaaagcccctgaaagcagtcagtctgccagcactaaagtgaagctttttacagtgaaacaatgccacaaggaatgacgagggccatgtcaaaaggacttaggggctaacctgaagaggctaccactggccatatatgaaagaatttttgctttcataaatagtcatatgctgcatgacataatagtaacaatgaaccaaatatacaatggtggtcctataagattttttttcaatcctccgagacatctgaatcccaaaagatttaataccatatttttattgtaccttttctatgtttagatacacaaatacctaccattgtgttacaattgcctacagtattcaatatagtaccatactgtacaggtttgtagcccagaagcaacaggctataacatatagcctaggtgtgtagtaagctaggtttgtgtaagtacaccctgtgatgtttgcaaagtgactaaatcacctaatgacacatttctcagaacatatgcccgtcattgaatgatgcatgattgtgtaataattatagtagcttgaaatccatcaaatacacttaaatccatgagttcattatgatattagaaaaataatttgtcgtcaggagatcgagaccatcctggctaacacagtgaaaccccgtctctaataaaaatacaaaaaattagccgggcgaggtagtgggcgcctgtagtcccagctactcgggaggctgaggcaggagaatggcgtgaaccccggggggcggagcctgcagtgagccgagatcgcgccactgcactccagcctgggcgacagagcgagactccgtctcaaaaaaaaaaaaaaaaaaaaaaagcaaaagaatttgtcatcttcagaggatgtaagggaactacttcatttccttgaaaactacttaagtaaaagggaagaatcaagcattatccaacctttcctctacgtgaactgtcccacttgggtagatgaagggaatgtctctttatgaatgtattctgatcagtaatggaaaaacaaatgacagaattagaatatccctatttgctagccccagtgaattaataggtatagccattaagcatcaacagctgctaacttgggaaaagaaacaatcagacattttgtgcctctgatagcctgatatgagggtgcaatcagcagaagccagcctgtagaaaactctacaggtcaaaagcccaggttcttcaatggataggttataagaaaaagaaaagcacaggaaaggaagcaatcaataaaatgaaaaggcaacctatgtactgggaaaaaatgtttgcaaactacattaaggggttaatattcaaaatttacaaagaactcttacaagtcaattgcggaaaaagaaacaaaaaatgggtgaaggatctgaacagacatttctccaatgaagacataaaaatgtctagcaggtatcttagtccattttcttttgccataacagaatatctgagattggataatttataacaatattagtttattttgctcatggttctggagactggcaagtccaaaggcatagcaccagcatctgctcagcatctggtgaggatctgcttgctgtgtcaccccatagcagaaggcagaagggcaagcgagtgcacgcaagagcaagagagagctgaacttacttttagaacaaacccactctcttgataacaaacccactcccttgacactgacagaaacccattcatgagggctgacttcatgacctaaccatctcttaaaggtcccacctcccaacactgttgcattagggattaagtttccaacacatgaactttggaggacacattcaagtatagcaacaggtatatgaaaagatgctcgatatcactaatcaccaaggaaatgcaaatgaaaaccacaatgagatatcacttcatattcatcagaatggcaattatcaaaaagacaagcgataacaagtgttggtgagggtgtggagaaaaggaaaccctagtatactgttggtgggaatgtagattcatacaacccttatggaaaacactatggaggttcctaaggaagttgaaattagacctaccacatgacccagcagaccctgacccagcagaccctcttctgagtatagacccaaaggaagtgaaatcaccctctcataaagatatctgcactcccatgatcagtgcagcattaatttacaatggccaagatatggaaacaacctaggtgtctgttgacagataagtggataaagatattgtggcatgtgcatcgcatcacactatgaaatattattcatccttaaaaaggaaggagatcctgccatttgcaaaaagatagatggatctagaggacattatgttaagtgaaacaggccagacacagaaagacaaatactgaatgatctgttttgtacgtggggggaaaaggtcaaatgtactgtggtatatttataaatatataaaaaaaaaactggttaccagggacaagatgggaggaaatgggaagatgtaggtcaaaggatacaaagtagcaaatatgtaagaggagcaagtcgagagatccaatgtacagcatgaggactgcagctaaagatccaaccagcatctaatgcaattgtattgccttagggatttctgtgaaataagtagatttttgctgctattgacacacacaaagtaaacatgtgagattgtatgttaatttccttcactatagtaaccatttactatccattggtatcctataaggtcatgttgtaaactccaaattatatacaataaaatttacttttaaaaagaaaagaaaaagggacagaggagatatctatggattaaatgatacttaaaagacacatcaaaatgtttaagtgtgcctagcagatactcatttgagtgataaaaacattaaaaatgcaaagaagatatttctatacatgtcaggatggtagttatttatggggagaagaaggaggttatgatcgagaaggacacatggagggacttctgttgtgggtggcaaagttctatttgtcaatacatttgttttatgtggtttgcaatatttgtgttttcttttctttctttttttttgacagagttttttgctcttgtcgcccaggctggagggcagtggtgtgatcttggctcactgcaacctccacctcccagtttcaagcgattctcctgcctcagcctcccaagtagctgggattacaggcatgcaccaccatgcccggctaattttttgtatctttagtagaaatggggtttcgccatgttggtcaggctggtctcgaactcctgacctcaggtgacctgcctgcctcagcctcccaaagtgctgggattacaggcgtgaaccaccgtgcccggccttgtgttttcttttatgacaaaaaaaatcttaaaacaattcctctgtacagggcacatttgtggattcattcaatcaatatttaccgagtgtccactatgtgccagacactgtgcatgtaaagaaaaagggtgctatgtttatcagggagttcgtaagctcacaggatgaggaaggaaagcagaggtttatgctcaatgtccagcatcaactaccagatgtgaggagagggagtcagagtataaataagagataagtagaggggtctgaacctaagaagttcagagatgggtcaggaagtaaagagtacaaaagatgatggtgaacacttcagaatagagggtgtggggatgttaggacctgagggctgccctctcttcttactgagatgtttgcattttatggaaacataaaattgcaggcttgctggcttcaagtagctgcactggacttcaccttctcccctcaggccttctctgctgggtaggtcatgagcagcttgggaagccaagatggaaaagggtgaggtcaagagttcacgatagactgtgaagatgagcctgggtcaagaggatatagaaagcggaatcactatgcaaacaagtatccataacagtaacttagagaaatggagtacaaaaatgggcagggggaggcactgaattgaaagtcaggagacctgaatttgaattccgattctactttctgtgtgactttgagcacacagtacttgagtaactcaacttctgcaaacctcagtcctgtcatctgtaaatgtaaatagtaaaccctggcctgtcacccttatggtatgattgtagtgaaccaatgagaaacaatggcaaaacattatcaatgtaaaagtaacttataaaacgacaatgtgggctgggtgcggtggctcacgcctgttatcccagcagtttgggagaccgagacgggtggatcacttgaagtctggaattcgagaccagcctgaccaacatggtgaaaccccgtctctactaaaaatacaaaaattagccaggtgtgatggcacgcacctgtaatcccaactactcaggaggctgaggcagaattgcttgaacccagtatgtggaggttgcagttagccgagattgggccactgcactccagcctgggcaacagagtgagacttcatcttaaataaataaataaataaataaataaataaataaataaataaaaataaaatgacaatgtgactgttggcccccagggctcatggcatcacttgccttggggaaactgcttctccccttctggagcccatgtctccatactatacaatgatgagctctgagggcttttccagctctgaccatcgaaagatccacttcccatcagcctttcctgccacagcaaccaagctgactcattaccaccgaccagtatcatctctaacaacaaaaccctgcaatatcctgtaaccttgtggaaaggtgtttgtgctaatttctagtctcctccaggaaggtgtgtttaggtcacaggcttgttagtttttaaaaaattgttagagaacagtttaatcccattcttctgagagtaaaagctacacattgttctcatcttaaaacaatccaacttgctgattacatagttaacaaacatctccaagtttgtttcttaatggagtgaacaaaggtgcgagtacctgcaaggctgaagtgggtcctatgcaatggcaggtgtcaccgcccccccaaattcatatgttaaactcctaagcccccagtatccccgaatataaacttatatggaaatagtctttagcaagttaaagtggggtcataatcaaatatgactggtgtcttcataaaaaggggaaattggaacacagagatgcatagaaggaagacatcgtgaaaagacacagagagaagatggccatctacaagtcaaggagagaagcctggaacacatccttccctcacagccttgagaaggaaccaaatctgctgacagctcaatttcagatgtccagcctccagaactgtgagactataatgacctctcttgtctaagccacccagtctgtggtactttgttacagcagccctgggaaactaatacactctgcaacctttattatgcatctgaatcacctggaaggacttccacttccagccacattagtgtactggacactgaacttgcctcctacccataaaaccaattagaaaactagaccaaataaatacatgaaatagacattagatggcagtcagtgcagagctatggcctctataaaaaggaaagcaaaagaggtgagtccctgatcaccctggctttcatcctgtaagcactttctcaaccatggctatctcacagagttgagaaagcagagatcggaattctgggtggttgaggtggctagaatttgcaggacaaaggaccacagagaacacagttatgtagagaaagagctctacaaatctacataggtgtttccccatgagactttggctgaatactaacattcatgtgtgtagagtgaaaccctatgaggtgcatcctaaaacaactactgaagacccccaatctaaacaactgccagagctcacacagggctgggagatgtttgagtgctgatcagccataatggagagacctggaacattcagtagagactcaaagagaggccacatcttagaagcaggagtaaggccaaactagccctagagtacaggctgctctagacttgccctaagaaagcttaaaaagaaggcttggaatgatcaagttcatcagcaaggtaatgaattgctggccaaaacaaaaattcaacactctaaggaaagacaaaagcagacactcaacaatataatatttacaatgaaaacacccaagaaattactaaatatgcaaagaagcataaaaatatgactcataaccaaaggaaaaatcagtcaatagaaagaaacctagaaataacagagatgatagaataagcagacaactttgaaacagctattataacatttgagatttaaaggaaaatacgaacataatgagagaaatggaagttacagacaagaaaaaaatggaacatgtgtaggtaaaaaatacaatatctgaaacaaaaaaaatacactagatgggcataataacatctcagactctgaagaagtgatcatcaaacctgaagcacagatagaaaagcctgggaagagaggaataaccagaatcacccagagagctgttaaaaatgcacattcctggacctcacctccagagatcctaattcaccaggcctgacttggtgcagaggtgcagatcacgatgcataaaagtaagcggccacagatgaaaataaaagaggcttcatccagtctcatttcccttaactaccatctatttgatgatggtttacaaaattatgtttccaatctggatctttcccatgaacttcagacccatatagccaaccatctaactgacatctccacttacatatctaagaggtctgtcaaacttaacagggccaaaatgcagcttttatttcatggccacttaaccctctcctctcccagcctctcagtacctcccaatggtatcgccatccttccattctgtaaatacaaaaactttggagtgatctttgcttccactctccatatccaaaccactagtgagttctgttgactctactttcaaaacattccaaatcaatccacttctctccatgcaccacccctgccccacaaccaccctagtccaagtcaccattgtctttcacctgagtaattgaaatagcctcttgtcttcccacatccactctcaactccccccataaattcattcttaacaaagaagtcaataacattttaaaatcataaatcagatcatgttgttcccttggttagcaccctccaaaggcttcccaataaattaataacaaaacccaaactctttcacatagcctagaacgtcccacatgaactggctctgcctgtctctcccacttcacatctcagccactctcttgctcttccacactggtctttttgctgttcctgaacatgtagaatctcctctccatcttgggggctttgccttacttgttccttctccatggaatactctgtcacacagatccttgcatggctgccatgcagatctctgcttcctgttattgacacctgaacttaattgtcatctctcagagagaccctctctgatcatccatattgaagtggccagccacagtcattctctgcctccagcactagaatgtgagctcccggacagtagagactttgtctgtcttgatcactgttttatcctctgggcctagtagtgcctggcacaggatagttgctcagtaaatacttgttgaatgaatgaattgtacatgtgatttcatgatatcatagacctaggtttaaaacactactcttgaggaacaagactagtattgtagtttatagcaaacctaatcaccagaatgtactcatcacatatttatgtgctaggagctggagatgtaacagtgaaccagatagacacagtctccaagctggaacttaggctgtcaggcaaggcatcataccagagttttaactcaaaaccagcaaatactctatccagatattgcagcatgttgttcaggattaaactgaacaacgaacaaggcttagaagtttggacacgttcctcctgcactcaattctacttgcacagtaaaataaacctggctgggttatagcaagtttcacttctttggctccagaattcactccaataaaattgaagtggcccgcctggattgtatccattgtcaaaagacacagaaatgaactgagaaacatcctgaaaatctctgaggctgtaaagagacacctctgatttaaactacttttctggtgagagtgattattgtccctttgtttcagcagaattggccctctgccccctctgcggtggtgaaatcccaaagctgtgaaatcatttccttcacatgtgcacaggaggggtcagcaacctgccttcagagccaggctttccaactcaggctgagggaggagaacctatacctatctgcatttggagctctacgttttgatccttcaatactgctgtcatttcagcaatgacactttttgactgaatctgccaaaaggaattgtgtgggcctcttcccctcctgacccatggacgtgcttcatactgtcctggccaagagcgcctagagcgccaggattttggtgctcagattctgattgttctgattgcttacaggtgttggtctccttctgcgctgctttttcagtggccttattgaccaggtataggagatgcctcagattaaaagacaacaaggagaaaaaaaaatgttgctaagatcctacctgaaccaactgtgaaaggctttcaagttgaatgtaaattgatgagacgttggagatggaactagcttggggagcagttggagttacagatagaacacagaaatcctggaaaccaagccacacccagtaaacagcaactggctccaactttccctgggatcttagcctgtgctgacctaaactgtatgctctgtgaaggcaaggacgttgcccatcttggtccctaaagtacctccaacatctttaacagtcttggcatacaatacgtactcaatgtgttgttgtggacagcatgactgactaaagtatggctataaaggggcaacacaggggatctttgtgatggaacagttcagtattggtttcagtggtgggtacatgactctacacaggtgatgaaatcacacagagctacacatgcacacacatgcacgtgtaaggggtgacatctacagctgctcttagagggtatcaatgtcatttgctgttgtgagaccgaactagaattatgctagatggcgacactgagggaactggggggaaaaggtgcactggtttcctggacatttctttacaacttcctgtgaatctagtgatttcaaaatagtaagtttacaaaaagacactcaatccaaaggaaattttaaaagtgcagaaaaagaaacctagaaaagatagggcaaataaaaagcacaataagatgcttgactttaatccaaaggcacccatgattactttaaatgtaaatggactcaatgctcttgtgaaaagacatttatccaatgcctactgtgaaccaagcccggttggttgcaagggaaacagcgaagaatatgacccaggccctgctcctatgatgctcggtgcaatgaaccaagaactgggccaaatgctgttaatgagtgccacctggatgagttcgtaactgccagaggtttggagtgacggaagatgaagctagagatgtggcagtagcagacaagttgcaaggagaattaacaggactgggtcaccaaatgcatgtgggccaccagggagaggaaaggattcagactgaatcacagggttctggtttgcaattagcagataatactattgtgtaacatgctatcagggcctcatggaacaagggcaaatgagctttcactgatgacatttctttctcctacaagtttttatcaattgacattcctaatctcgtgcagtggtcagggcagctactaccctaactttccagaaaaagaaactggtactcagacagatgaagtggctttctcactgagtaacagtgaatctgaacccatggctcccccattcagtgttcaacaacattgtttcaaattatttgaaattaaagaagagagaaaacagagccacagtaaggagagggtatgtgcccgttcaagttggttgatgacccttcaagatagcttagaactttaccaggcaagttttcaagctggttgctcctgccacgctctgcagtttgctgtgggggtatctgcagggaaacagtcatgtgctagagcactttgggcactgttctatcacatggaactgtcaaagttatttcctctgatttagctctgtattgcaaagttggatatttctgtcccttcatgtgcaaacattctttggagtccagaagacacagaggaaaagaaggaaagaggaataagaattgctcttgtctgatttactgacttttcatttcctttgacacccttcctcacccctgttcctctgactatggacaactttcccctaccgtgtttttcttgttcttgtgttgctattgacatatacttagtagattctagttactgtttagaaaacctaacaactcaattactgactgccacttgcaaggcccctaggaattttggatgtggtcccagaacatgaaatgaaataaagcatttggtaacaacttagagatttttggtaacctcccaagacctgctcctctaagctgatctcccgttctctgcccagtagctacaccttgaacgcactcacgaggctgggggttgtttatgtgttgcaaaaggtaagcatcattaaagaaacagaaatctggttaattttctattttctgctgagctttactcaagagggccctttccctccaccttctacttccttgccaaggggggccacaaaggttgggagtttccaggagcaggttacacacttctcctctctatcctggctcaatgccactagccctgggattgccggtgacctttcagcctgatggcctgtaaccttctgctccctgccagatagagttgggacttgtccaaggcgtggaataacttcctgtgattgtcctgaagatggcctggcccacaggatctgcttctatagcttgtcaacagaagcagaaaagtcctgtatctctacagtatggtgggccttggaagggagaatcctgaggagaaatgttcagcaaagataagtacaccaagaggtctgtgttcaagtacatacatgacatggacttgaccttcctcatgtattgtcaaccaaagtgccactgaatatcctggccagtttctcattatttcttgtgtggcagaatctttgaggtcattaagaccagctaatcaaatctgcaagtgtttacaaacctgggagggtcactaatatgttaggtcaggatcaggatgcaaaattacgggttgaaaccatgggccaaaaccaactcaggaataaagttattttaaactctggtaagttctgtgatacattaagtgtctgaggtgcagtggaggtaatcaagtctggatggagaatcaaggaaggtgcaatatagaggaagtgacggcgcagctgaactcaccagttgtgtgagaccaatgtggttgaggggaggctcttctaagcagaggtacttgcaaaacattaagaataactccaaagtgttaggtataattagtggtgatggttacacaacattatgaaggtacagtagttaatgccactgaactgtccccttacgcgtgattaaaatggtcaatattatgttatgcatcttttcccacaagaaaagtaatgaaaaatgttaccctcacacccatgggtgtccgctagggacattccccattgcccaagctgagtgcacaggtgtggtggctcctgggattgtctctaaaggagtccattaacaatgagaagatatcagtaccagagtcacagacaaacatgaagtaacacagatccctcaaaatatgcaatagcaatattaatagctaacacgtatatcccaggaattattctaaatgctttaaattaaattaaatcatttgacgctcacacagaccccatgtgagtgaatactctttttagggcattctatacatatgcagaaactgaggcacacagaggttgagcaagttgcggtcgggcaagagcgaatatgtagcagaggtggccatgaaatcagatcgtctgcttcggtctggttcctaatcacagactatgtgtgatgtcgagaagctgtcatccgctgactagagctatgtaggtcaaagagcttagcacatcagaagagtgagcagtgggtgaggagtcaaagaggaacctcattccacatgaagaaaagcatgagctgaatgactgggattgtggaagagtgtgtattcaggttaaaaggtctaggagaggagaaaaatacaacatcattttgtaaaaatgagctcatagtctagcaagaggtcctcctattttttttcctaaaatacatgaatttggaaagcattcagaaaaccttgtatctggtgttatcggacataatataatctgacgtttaatactgaagaaagtctttctcaaatgtcccaacagtgcctggtgcctaacagggactcagtaaatcttgttgaattaattaatgaatctctatctcattccacatataataaaaataaattcttcctggattaaacatttacattgaaataaagaaactgacagtactgaaaaaatagaggtggacacttacgtaatactggcagctgggaaggctttctaaccatatatgaattcctaaaaagtagaaatgcttgaaacacctaagtgttgtgtgtgagtctaagggtgagagggaagaaaagagatgacaggggaaggagtgagccgttctagaaagggtcccagcaccccagggtcagtgggaaacccagcagtcagctacagccccaaatgaattttttcagggtggttcatcagttctaagtactcctctggctggaggaagttgccaaaaccacctccgagcccccggccagcacataaccttgagtcaatagaagctgctccatcagagaccacagggcaccagtgtttacttaagctcctgtctcagcgtgggagaagttaagaccccagagggcatctgcctgctgacttatccccaggtacttggagaggaaaagaacactctcaatttcaacttggtttcattacttgcttggctcaaagcacatctgctagaaggaagaactctttattgcttacagttccagacaaactcttggcctcttcactgttgacccaaatgccctttctttcctcccaagaatacatgtgcaagttagggttcagaaaatgtttgctgaatgaatcagtgagcactggtccagaatatgtcaatatgcacactcagatacaacaacaccaaccagtctcatttgcaattcaatgtatgctattttttatgtgtcacgtccctttgtgaactgctgtgaactgtctgtgaactgctgttcatgtatgttgcccattttccaattgtgatgctgatctttttctaatcattgatcaggattactcataaaagtgaagaatatgaactctttgcttgcctcgtatgatgtgaaaaactttcgcattttgtcatttgccttataagttggtattgtttttgaagtacctaaaatagtgttcagcatataggagacactcactagattatttgttggagaaccgactgaataaataaatgagcaaagagatatgttttattttcatgtagcaaaaatccttctctcctcctttatggtttttcctctgctatcatgtttagaaaggttttcccaaccccacgatcagattgagattcaataacattgtcccttctagaaattatattatttcgttttctttacatttaaatacaacatatatctagaatttgtctctcatatctgcgttaagtgagattgatctacaattttcttttttgtaccgtaagctctttacctaatttggtataagggtcatagctcaagagatctcaaatctaaagactttccgagtcagttatctgtcctggaggtaattatctgacaataactttcatctcttatatttacttacaatgttgatcagtctaacattttaggggctaacactttgaagagtgtaccttttttttggcaaggtgatgttagaattctcatttggtgtgaaaatttgggtggggttaaattactgtttaaacctcagtttaacttctaattacactgttctcctggccaaagaccctaaaccactgatttcttgttagcactaaaagccacaatgtaacagactggcttcttgtgaaataggaaccaaatactgccagaactggaagcctctaacaggaagtcatgacttagtggtgaaataactaaagaaaaggaggggacagaaaagcagccattcccctttgggggcctagctgtcactttgctgctgttgccttttagtaagtaatagccaaagctttagcttggtctagagcatggtgacgttcttatgtgcaaagaaggcaaaataggctgaattacttggatagaaattctccagtgaaaggctacaaatatgagtaagtcaaacaaataatcactgtgcagaatgctaatgttgtaacagagggaagtccagggcctaagagggaggatgggaaggttttcgcccacacactttgcaggtcagtgggacgttcttacaaggctctacttggcaggaagacactgtgttttcaggcactgggcacaacccacaagggaaggaaccccgactttgatgtagcacactgcaggccctggggagacagcgctgagcaaggcgctcagggagggagacagacaagtaaacagaggggctgctttgcaagggaaggaaactgactttgatcgctgtttccactctaacgcttgcccttagctacagagacagcagatctggagccaccccagccaaggcttcccagcatgctttgagcacatccagtctgactgaagtgggggctaacctcctattatgcgatctggaagccttctccactccaagattatcaaaatattttcctatgttttcttttaatcttctatgttgaattacacataaatgtgtatgtaataaacaaagcacaaaaagagcttctatgagacgttaagataaatatgaatgacctaattaatagaaaaacatgggcaaaatatatgaatcagtatttcacagaaaaagaaacagaaatggccccaaactatatatccatatctaattttaaatgagacatctttgtatataagcctggcaaaaatgttcaaacatgtgcaatgtatcttaatgtcattcttcataataactaaaaatcagaaagaaactaaatatctatcaaaaggttgaataaattatggtatgaataagcaaaccacacacataagcccctccaccccagtctacgcttatattttggcaatctccgcactctcatgtgctgtgattatttgagtgccattcccttcatcccatttacaagtcggagtgaaatgaaaagtctataactccaaaagcaaattttcaaaacaattaaatgcagactgttcacaagacatcttcccagaatggagcccatgggggtagttggggctttcacatctcagtacatggcaactctatccttccagctgctcaggccaagacactggaattctcgactcctttctttctcttgcatagaataaccaatccatcagaaaatcttaccggttctacctttagaatatacccctctccacgcatctcacctgtatcactgcactagcccctcacctggtctccctgcttctgccctggcccctacagcttgcaggcagctgccagagtgatcctgttacaattcacatcaaatcatgtcagttctgttctcagaaccctctggtgtcttcctcccttactcagacgaaaagccaaaggctaaagtaaggcctctactcacatcaccactctgacctcatttgctccattccttactccctgggctgcagccaagctcactgctcttggaacattccaggcgtgttcctgcttcagaggctgtacattgtccatcccctcccatgattaaggagtggggtatgccattcccagacactttcagctctctaacatgcaagcaaaatggtctctagtaggccaatagcaatctcccaaacaggagctgccgctgttggaagtgaaagccccccaaagtgggggaagaggagcacatcctccaatatctttccgtggtactagtactagcggtgctagtaatacaatatgaattggtcacctttattggctacttatgaagtgcattacatataactcacttcatcctcacaacaaacccatgacgcaggacattagtcaaccttgacaagagcagttttgatggagtggtggagtaaacacttgattaggagcgaatgagaaatagaatctcaccatttgtaatccttaatgaattaatcaatttaagcattaagcatcagtggctgctacaatcacaaaaagggagacaaccagatacgattttcctcctaatggaagtacaataataccacctaggaagagttcattatattattctctcagaaaataacaacatatttgagtgctgactgttatcatctagagccaagtggatccacatactgccatcttccaatttaaaaagagtaaaatgctagacttgaagttttctttctgcttttctgtggtgtgtacgtattttggtgctaagatcttaaagtcttgtatccgattcacggtaaaggtttaaggtattcatcaaatgcaggggcagggagaataagccagggttggacctgagtgacctctctgccatttagagagcttgtcccaaagcatttggcctgtggaggaaccagtccaaggatttttcctattaagacttctaacctgtgcactttatcctcaatctcacaaatacctattggcagaactcatctaaaacacacacttcaggccctaaagatgtagttagccctttggaaaattgttgacttcgagtccatctcatcacttggttgtatttctttctttatcaggcctgggtctgatagcctgggtcactggttttctggttgacactgcaaatgaataaatactttcctcccatttgtgtctttcacttttaactaccatctcatctcctttctcttccactgccacacttcttgctgtcgttgctacccatttcttcctaaaccattaatattgggaatccacttcaccagaaagactcggaagccccacttagacttcaggcccaagtagctgtctccaattcagctttttcagtgatgaaacagctgttttgcatccatcttccttatcttgtgccccttgtccattccttctctgtgccctatcagtcagagccctgggaggaaaggcgggtgactggcattaccactgcaaggtatttagggttatccatcgcctctaatggtctctcctcttatctcttctcagttttgctgacacttttcctcttactctctaactgcggtatctcccaaaattctgccctaggtccttttccttcttactcatcacaccctccttggataatctcatccaccccgataactttaactacttcctataccccagtaaccaccaaaactccatctggagcccaggtccctcccctcagctctagacaaatttacccacggttacttcaaactcggtatgtgccagcctgaacgtaccagtctcactggcttgcccccaaactgggtcttttctcccatgctcttgctcacagtgtttgtatgacatagtcagtgtccagaaagatgtggcgtaaaaaatcaattacaggccaggcgcagtgtaatcccagcactttgggaggccgaggcaggaggatgacctgaggtcaggagttcgagcctgggcaacatggtgaagccccgtctctactaaaaatacaaaaattagccgggcatggtggcaggcgccagtaatcccagcttttcaggaggctgaggcaggagaactgcttgaacctgggaggtggaggttgcaatgagctgagattgcaccactgcactccagcctgggcaacagagtgagatcctgtttcaaaaaaataaaaaagaatcaattacaaaaataaataaataaaagatgaaattcaacagtaataatgtaggtcctgttcctgggcttaagcaaaacagcaatagcacaagaacagactggagaaaagatagcttagctgaaacacagaggaaatctaagtccgtttgacaggaagctcagtgtgagtcaacggtgtggcgtggctgccagaacaaagctaatggaatctccagctgctttctcagaagcacgatgtccagatgagcaatgatggtcctggaggagtttatttagttctggtaccagttcagaggaaatatacaggacagtgagggaactcagaactctgttctatcctaaggaatgactgagtaagctggcaacatttagattggatatttgcagggctctcaaattgaaaaagaattagaggtgttctgtatattctaaggaggttaacaccaggaccaatttcttgcagtcagaactatcacacgattatttgggcagcatattatgtaaccggtttcctgtcattggaagtgtccagataacaaatggctggcaaaaatgtggccagcattggagttgctgtaattcatcttgggctaatcacccttctcctcgtccctactcctgtcaagttcaaaatctttaattacgccctctctcacataccttataattaagcaatcaacatttcccattgattatttctctaaaatattctcatattttcccttctgctgcattcacattattaccctggactaagtcgccttgcctaggaaagatttttttaaaaaggatatcttcaaataccatcccaatcaacctgacttccagaatctaagtggcaatctggagtaacattgtcagttgttttggccacccagcatctgcacctttttctatatttggggaattcccaactccagttatagaagcaagaaatgatggatcctttcttttccagtctccattacaatgaaggtacagattctgatcgtctttcctgacagtttaacctcaagattgcttcggcagatcccacaacagtattttttatctgcctaattaaatcatcatctagttacctgaaatgacatgcccactaaagataaggttttgagggagtggggagtgggagcccagtgtcaaaaattaaagtttttattaaagatatatgatttaaaaaaacaaagcttctcagtaccatgccctgaaactcattaacagaagctgcttttacatatttacaccatacttaaagtatactcacgtcatccatgtgtattgcagcactattcacaatagccaagctacagaatcaacctaagtgtccattaatggatgaatggaaaaagaaaatgtagtacatacacacaatggaatacaattcagccataaaaaagaatgaaatcctgtcattcacagcaacacggatggaactggaggttattatattaagtgaaatcaataaaagaaaaaagatgaactctggccactgacatggagacaattctaggataaatttttaaatgaacagactaatgtacagaacattgtgtatcttttgtgtaagaaaaggaggaataagaagctgtatatgtatttccttgtgttcatataaagaaatactgaaaagattaaagaaaaaaattaaaaaatggttatttgggggtaagggtaaatagggtggatgaagacagaggtggaagaagttttcatcaaacatttaaaatatattttttaatttttgaaacatgactgcattacctatttggtagcaatttttaaaactaagtcaaaagtagaagaattgacaggaagatcaacaaaactgccccaaaacagacccaatgaaggatttaagatttaggttacatttaagataattttctagaaacagaaatataaatggcttttatacttgaagagatgttcaacctcactcacaaagaaatttaattaaaacaagataccatttatcatctattgatttttcaaagataaaaacatttaacagtacactgtatttgaggacaagcactttcatactctgttgctgagagtaaaaattggcattatacgtttacatgcacttcaactcagcaattcaacttctaagagttttttttacaagcataattgcacataaccacaaagaccaatgtacaaagatatttaccacagtattgtttacagcagcatgagactggaaacaagagaagttctatcatagtatctccacatagtgaaatattatgaagctgttatggactgatatggaccaatctccaaaatacattactaagaaaggaggttacaaaatagtgagtatagtgtgctaccatttgtgcaaaaaatggggaagtatatgtgcttgtatatgcatggaatatatctgaaaagaaaatcaagaaacttgtctcagaaaagaaatataagggttctccgcttctaggaatgtaaaaagatgcaaagaacatccttcccactatgacgagaaaagctggacaaaacacaaaatcttcattttcttgagcccatcagagagtggaggtcacaaggcgcccaagtgatctgacttccacagagggatgacaatcccttcccacggtatataggactcatggaggagatccctcccttagtggtgatcctaagcacagagacttccagttgctgaggtagcccacgacccagaaaacaagctacctgtatagccaacccaggtccctggccttcctcttcaccataacaggaaagaattaaagtagatatctatcaacagaattctcacttaagctgaaggaattcactgttcaatctggaacagaatttctccctcttggcaccacttggacccatttgggccaaattcattgtggtggaggaccgtcctgtgcattgcagaacatttagcagcatccctggcctctacctactagagaatgcatccacggagatatggtttggctgtgtctccatgcaaacttcatcttgaattgtagctcctatactataattcccacatgttgtgggagggaccagtgggagataactgaatcatggaggcaggtctttcccatgctattctcacgatagcaaataagtctcacaagatctgatggttttataaaggggagtttccctgcacaagttctttctcttgtctgctgccatgtgagacgtgcctttcaccttccaccatgattgtgaagcctccgccgccacgtggaactttgagcccattaaacctctttcttttgtaaattgcccagtctctggtatgtctgtattagcagtgtgaaaacagactaatatatgtggtgtattagtccgttctcacactgccatgaagacatacccaagactgggtaatttataaaggaaaaaggttgggccgggcatggtggctcacacctgtaatcccagcactttgggaggccgaggcgggtggatcacgaggtcaggagttcaagaccagcctagccaacatggtgaaaccccatctctgctaaaaatacagaaatgagccgggtgcagtggcaggcgcctgtaatcccagctactcgggaggctgaggcaggagaattgtttgaacctgggaggcggagcttgccgtgagccgaggtcatgtcactgcactctagcctgggcaacagagcaagactccatctcaaaaaaaaaaaaaaaaaaaaaggaaaagaggaaaaggtttaattgactcacagttccacattgctggggaggcctcaggaaatgtacaatcatggcagaaggcaaaggagaaacaggtaccctcttcacagggcagcaggatgaagtgagtgcaagcaggggaaatgccagacctttataaaaccatcatatctcgtgagattcactcgatagcatgagaagcatgggggaaactgcccccataatctgattatcaattacctccacttggtcctgcccttgacatgtggggattatggggattacaattcaaggtgagatttgggtggaaacacagagccaaaccatatctcgtgggttccatcaaccataggttcaaccaaccacaaattgaaattagaagtaaaaaacagaaagatatctaggtaattcccaaatatttggaaattacacaatacatttctaaataacccgcaggtcacagaaaaaaactacaagggaaattagaagatatcttgaagtgaataaaaccaaaaatacaacatatcaccagaatttgtggaatgccattaaagcagtgccaagggggaaatttgtagcactaaatgtctatgcagttgatcctcaacttacagtggagttacatcccaagaaacccatcataagttgaatataccctaagtcaaaaatgcatttaatacacctaacctattgaacttcatagcttagcctagcctaccttacatgtgctcagaacacttacattagcctacagttgggcaaaatcatctcacacaaagcctattttataatagttataaggaattttgaatcaaaattcaaaatttgaagtatagtttctactaatgagtgttgctttcatgccatcgtaaagcaaaaaaagtcataagtcaaaccatcgtaagtcaggaaccatctgtattagaaaataagaaagatctcatatcaatggccacagcttctactttaaatgaatttcagaaagtacactggctgctgtggggtcaatgctaagggaaagaagccagacataaaaggaccacatagtctatcattccacttatatgaaatttccagaaaaggcaaatctatagagacagaaagcagatcagttgctgcctggggctagagataggagtgaggagtgactgcaaataggctaagggaattttttgtggggatagaaatggtctaaagctagaccacagtgatggttgcataactgtataaatttactcaaagtcaaccaactgtacacttatgatgggtgaattctatagtgtgtgtacatatatatatatatatatatatatgtacacacacatacacacacacatacctcaataaagctgtctttaaaaaccactgaaatctgtggaatgggttcccaggatgttaagccaaggaagacagaatataatattggatcaagctaaatgtattaatgtgtgtgtgtgtgtatttcctgattgataaagtgacatctttaaggtgctgaaaagaaaaacaaaacaaaacaaaacaaaatttttaaactgtcaacccataattctatgcccagtgaaaatattttttaaaatgagggagaaatagactttctcagacaaacaaaacagagaagtcactgccagcagacctaaactacatgaaatgctgaaggaagttcttcaggcagaaggaatatgatagcagacagaaacttgaacctacataaagaaatgaagagtgacggaaatggaataaataaaagaaaaataaaagtttagttttttctctttgttttaattgactgaaaagataactggttgtctaaagcaaaattagtagtagtgtatcatacgtttatagcacatgtaaaagtaaaatgcatgacaacagcacaaagaatataagaatggaattgggaatatactattccaatgtccttatactactaatattataatgatataatattatttaaaggaagtctgcaactaattaaagatgtataatttacactccagggtaactgcaaaaatatgaagttatgaaatgtaagttaacaatggagataaaatggaataataaaaaaggctctattagcccaagagaaggcagaaactgaggagaaaagaaacaaagaacagatagaacaaatgaataacagctagcaagatggtgtattttaatataaacatttcaataatcatactttatgtgaatgaactaaatatgccaattaaaacaaggtgagaggctgggtgtggtggctcacacctgtaatcccagcactttgggaggccaagacaggcggatcacgaggtcaagagatcgagatcatcctggccaacatggtgaaaccccatctctactaaaaatacaaaaattagccagatgtggtggcgcgtgcctgtaatcccagctactcaggaggctgaggcaggagaactttgtgaacccaggaggcgggggttgcagtgagccgagatcgtgccactgcactccagcctggtgacagagtgagattccatctcaaaaaaaaaaaaaaaaaaaaaaaaaaaaaggcgttaaaaagcaagacccaactctatgctgtatataagaaacctacatcaaatatagacacagagaggttagaagtaaaagaatggaaaaagatacaccgtgcaagcacatatcaaaagaaagctattatcaaaaagacaatagaaagaagaaaatagacttcaaaacaaggaatagcatcagggacaaagcaagacattaaataatgaaaaaggcttctattccccaagaaaacatagtagttccaaatgtgtataactagaaatggagcatcaaaatatgtgaagtaaaaacaaatagaactggaggtagaaatgtggacactgtggacaaatctacaattacagatagaaactttcacattcctccctcagtaactgagagtaaaagtgaacagaaaatcagtaaggatacagaagaactgaataacattatcaaccaacctggcctaattaacatttatagaacactttacccaatgacagaagaatacatattttttcaagtgcttatgtacatgaagtgaaactatattgtgggccatgatatacatttaacaaattttaaagaatataaatcatatagagtttgttcttagatcataatggaatttaactagaaattaataatagaaagatatctagaaattccaatattgggaaattacataaacttccagaaaacccttggatcaaagaggaaatctcaggggaaaattaaataatactttgaaatgaattaaaatgaaaatgcaacatatccaattttgtgggatgcacctaaagtagtgcttagaaggaagattggccaggtgtggtggctcacgcctgtaatcccagcactttgggaggccaaggtgggctggatcacttgaggtcaagagttcaagaccagcctggccaatatggtgaaaccgcatctctactaaaaattcaaaaattagccaggcatggtggcaggtgcctgtaatcccacctactcaggaggctgaggcaggagaattgcttgaacccaggaggcagaggttgcagtgagctaagattgtgtcactgcactccagcctgggtgacaatgcgagactcagtctcagaaaaaaaaaaaaaggaagattatagcactaaatgcttatattagaaaataagaaaggtctcaaatcagtaatttaagtttcctccctaaggaactagataaagaagtgattaaattaaacccaatgcaatcaaaaggaggaaaataataaagataagaggataaattaatgaaattgaaagcagggagaaagtagagaaaataaacgaaaccaaaggatggttcctaaaaactaatgtaataaatgaaaactgaggcatcactacaaatcatacaggcatttaaaggataataagggaacataatgaacaactttctgccaataaattcaagaacttagacaaaatagagaaaagccttgaaagacactaacgacactcattcaagaagatatggataacccacatagccctatatctattaaagaaataaaatttggccaggcccagtggctcacacctgtaatcctagcactttgggaggccgaagcgggtggatcacctgaggtcaggagttcgagaccagcctggccaacatggcaaaaccctgtctctactaaaaatacaaaaattagccaggcatggtggtgggcacctgtaatcccagctacccgggaggctgaagctggagaatctcttgaacccaggaggtggaggttgcagcgagccaagatcgtgccactgcacttcagcctgggtgacaagagtgaaactccatctcaaaaaaaaaaaaaaaaaaaagaaagaaagaaaatttgtagttgatagccttcccaaaaagaaaagtataggcccagatgttttcaatggtgagttctaccaatcatttaaggaagaaggaataccaattctacacaacatctttcagaaaatacaagaggagggagaacttctgatttcattttatgatgccagcattatgctaatatcaaaaccaaagatagcataaaaaaggaaaactgcagaccgatatccctcatggacagagacaaatatcttcagccaaactatcagcaaagcaaatccagaaatatatgaaaagaataatatgttacaaccaactgaagtttatcccataagttcgaggttggttcaacatttaaaatcaagcagtgtaattcaccatagtaacagactaaaaaataaaaaacatatcatcatttttatagatgcaggaaacacaacaaaatccaactcatgagaagaagcctcagcaaactagcaagatgggggagcttcctcaatttggtaaaaggtgcctacaaaaagcctacagctaacatacttaaaaggtgaaaaatggaatgctttccctctaaaatcaagaaaaagtcaaggatgtctgctctcgtcatttctatgcaacatttatagtattgcaggttgcaactacagacaaggctattagaactaataagtgagtttagcaaggctatgggatatgaggtcagtgaaatcaattgacaaaccaatcctaaaattgccatagaaaaacaaaggacctaaaatagccaaaacaactctgagaaagaaaaagtttgagggctaaaataacctgatttcaagaattattgtaaagctacagtcattagtcattaaacagcatgttgttggcataaaacaaatagatcaatggaacagactagagaatccagaaatagatctacatggatatggtaaatggatttttttttagatagttttgctcttgtcgcccaggctggagtgcaatggtgtgatctcagctcactgcaacctccacctctggggttcaagcaattctcctgtctcagcctcccaagtagctgggattacaggtgcccaccaccatgcctggctaattttttttgtgtttttagtagagacagagtttcaccatgttggccaggctggtcttgaactcctgacctcaggagatcctccagcctcagcctcccaaagtgctgggattataggcgtgagccactgtgcccttcaggtaaattggtttttgatgatgtttcaaaagtaaatcaatggaataaaggcagtctactcaataaatagtactggaacaaatgaaatcggtatgcaagaaaagaaaccatgatacaaacctcacagcttttataaaatttactcaaaatggatcatagatctaaatataaaatatctaaatataaaatataaaattataaaactttcagaggccaggtacattggctcacgcctgtaatcccagcactttagaaggccaaggtggaaggatcacttgaggccaagagttggagaccagcctgcgggcaacatggagaaatcctgtcctctctacaaaaaatacaattagcagtgcatggtggggagcagctatagtgccagctactcaggagactgaggtgggaggatcacttgagcccaagaggtcaaggctgggtgacaaaggatcttaggctagatgaagagttgttagatttaacattaaatccatgattcataaaagaaaaattgtattggggatttcattaaaatttttaaattttagttcttcaaaagaggatgaaaagacaaaaactatgggctgctagaaaatatttgcaaattaaatatgcaacaaagaacctatatccagagaacctatatccagggacaaaaacagtgcctggctcttggcattgttttgaaaactaaatgagttaatacaagttcttagtgtagtgcctggcacatataaacattcaataaaagtgaactattatagctttattatcactgttattataggactctttaaaatggataaaaatagatgcaagccaaatgttcaccaatagagaaattgttatattatatgtattacaaggaatatttgacaatgctttaacgaatgaagtaaatctatatgtactaacctggaaagatgtccaggatgtttgtgaacaaagcaaattgcaggaccgttagtagaatatgatcccagttgtgcaaaaagaaaattatatattttctgaaaaattttgtagaatggtactcactgaacggctcacagttgttatccctgggttggggagtggaataaggaggagagcaaagggaaggtagcggggtaggggaaatttaaagggggtcttcacttttcattctatttattaacataagaatatatttcttgtgaaacaaaaaatacagatgaaaataactatcttttaaaagaccagtgataaaaaataactttctgattgtcttcactgatggattcaagtggatgaagtacaagcctactttggactgaaaggtttacctaaaaactgcctgagcttccatttgtaacagcaaacattgatggagtgctgcttgctggcctggcagcacgaataactgagttattgtcctggttgtgccaataactagttttgctatgttactattataaatgttaaactataaactggaatcaagtcttttttttctgtcttcccagcctgtaacacagggcctagttcggagttagcgctccgttaacgggagggagtgacaggaattgaatttaagcagctgtaacagccctatccaggccccgtcgaagtgacacatgatcaccatctagtggtgaaaaagattcctgcagaatttagctatgagaggaaaaagaattctttctgtggtgtgttccagggacagatgcctgtcagcgaaaaaagcattgactagatatgatctttcttagagacagttcccaaacatcaaggtttatgtcttggagtgttggtaagatgacacctaggtactcttgtgtcttaagtctagtcactgccccatcatcacacgccccacatatctctaagctgcgcagtgtccactcttgccacatcccctaaaggaatgaaccgcgtgtgataataggcacacacactcatgccttcccaaagttgatgaaatactaataaacttccctaagccagtctgcttaagatacaaaaaaagactgggaaataaaatattctataatctttgccctccaggggcatctttctgtatcatctactgaaattgtatagtgaacctttaaaatgtctgtcattccaaaggacaacaaggaaacccatcctgagtcaacactgcaagcactactgtgtgacaaaagcctcacctgctcatgcaggtgatgggagcaggttttcttctcttgcctcctttgagtagcttcacagttaaggaagcagctggataatgcagaggccaagagatattggaccctgtgcttatggactcctggactcaaaagcaaatgatgtagggacacactggcacttagagaaatctcagtatttatgcactcctgatattcacgtgctaaatagaacaaccttcctctaaagttctgttctgcagaacaaacaacaaaaatcttttcaaagacccctaagagagaaacacacactgtctagcccgatgtgaatggggaaagagggcttgagcaactctatgttcaggaaaatctcctgccacacattctggaagtattcatacattattaaagtctttttataatcccacctcttgaacttccacacaatatgtgcctcatctatgtgggaacaaaaacagttgtgaaatttggccagaagaggacagcagtttgagagcactgtatagacaagagcacaaggctgaaccacatttggggtgggctgctttggatgagcgcagacatgcgcgagtttgttcctaccaccgtgcagtgaagttgcagagaaattaggaattaagaacaagatgaatccatccagctactcccagcctaaaaaaagcaagaagtcctaatagctatttatatgcaactccctggggactgaagtggttcttcctaatggctgaaaaacactgagtagcaatcaggtctttaagcagaatgtttttaagaccttatcgtgaggacgctgatggagataatgaacgtttgaggtgtcgatagtacatcttaaaacggtaatggaataggtaggaagattcgctcttccaagtattcctaatttcatattagtaaaagtcagttgtccagctggcactataaaagcgcggtgtcagcattaagaagaagctgaaaggagttacacgatgagaaacgagttacactgtgtagggttccagacagcagtgtccgatgacagctacaagagcagcactccttactccttacggtccagggggaatgcaggcaattcccctctggctgtcagtctccctatcccctgccgcgtctccttcgcggggcgatgggtctcagagccacccccagccaaagaaaggggcacgctttcgagatgtctccctggccgctcctgtacggagagtggcgcctgaggtttcagccccaacccgcctccctccgctagagtcagcggcggtctggagtccctgagccccgcgggcaggcgccacctggtctccggcccgctgcctagcacagcggcgaagctggctcgacgtgcgatttcggtttccgtccgtcggcctcgcccgcagtcccgggcgctgggagcggctgcgcctggcgcgcccggagcccagcggctccccgcggccgccccgcgggcgggtgccccgggacgcgaaggccgggcgggtggcggcgcccctactcacgtagcgctgtagcttcctctcggggggcgacttaacgagccagccggtgcacactgcgtcgcccgcactcatcgtggccgccgccgccgcttcctccagctgggccagccgcccgcggcagaaggaagtcgggccaaggatgccggcggggcgggcccagcgcccgcccgcccagcgccgccccgagcggccgctgcgacccccgcctccggccgccgcggcccccggggagggaaccgacgccgcccgcaacccaagacggcgggaaaagcaagcagcgaagcctgggaagccccttcgagcaactgcagctccgccagcggctgtgcccggggggggggtgtgggggggggagcctacgcagcagggcgcctgccactctcacccagggtcacgagaaagcgctcggaaggagccctgcgacctaatgggagcacagcctggaacctgttgccctcatgccccatccccaatccgccacgccaaacgggctggtccctgggtctcagggaccctggagctgaaacccaagtaccacctgcatctgccatgtgcatagttcacggagaaacaaaagcaagactcctcttggacttccctattccacttgattgcttgcacagtagtgtgttttctatgtccctcccccaaagatcgttgtattcagtgataagctttgccggctaaacggtctaaatgtcttaatgaacccaaatgacccaaactcaaaaggtagtgctgtttgcaatctctttgactcgaaggttttaaaagatggatctaaagtcgattgtgccaactagtgtgctgaccacgctaagtaaaaataacaatcatgagcacctaacacttgtgaccttccttactgccaagctaacaccatgccagcgattgtgctaagcactttccaggcgttatctcattgaatccacacaacaccctgtcaaagggctcttattattatctcaattttgcaggttactaaaatgaaaaacaggatgacagtgtcacttgtcgagagccacacgagaaaatcatccataggcagccagagctgtgtcaagagcccatccacttaagcaccaccctctgctttttgtgggtatcatctatgtgacgtttgctagcatcttcaacagaatgaccaacctcccatcctatcaggccagatgcttcagggtgatgagctaacatggtaacaccagtggagtccatcagcatgcgcacactggcttataatgattttcttgtgtgagataatgtcagtgtgaataatgggttcagtaagtcaatgggcaggagtgccagcagaaatgtgaattttaaaaaagcgaatccatgtacaaaattagtacctgttcaagtgagaaaaaattgctgccccttccagatggcagtccaggtggctgtctggtccccccagggaatgctgttattaagggttcattgtttgtctctgcctgtgggcagcttgagcacttagcagtggctgtggccatatcaactgttgccagtccctgagagccccactatgcattgctaattctctaagtcttgcttacacctctgttaaaaaaaaaatcccttaattatactttcctcatttcaaccccttgagtctactgtttgcttccttttgaaaccttgaccgatagacctggtcatgaggaactccctacgacattctgggtgtaagtccagggaatggtgatcatgcagcagcaggggccacaaagatgtgagccacctgctctagcaactttcctgtaccttccagacctgcttgagtctggtctcaaatattccacttccaaaagaggatgaaatagcaccaaatttatcagtggcagctgaagttccatggttctttggtgccccatggtcaagcattcagactttgccacagcccaggagcaagctggaagctgttggtcaaaaggaaaatacttcttttgtggtagagggcatggtttacttcaaaactctagggctttgctgtgtgtttctcctactgggacttgccagaggctccgtgtagcctcccagtgtgtcaaaggtcctgtacctgttgaatctacatggtcataagggtcaagtggcctggacctgtcacagagccttttcttgccctggatctctccccgaaaacatgcaaccctacagatgacttgctgagtgcattggtgcggcacaattaaatgtagcatatgttgcctacaaaattcaaacatccacaccaaatgccgtgcctctttctgagtggtaggtggtaagcggtacaacaacatgttgaatacccaacgtggtccagaccatctaaaaactttgctgaggttcaggctcttgagttttcatggggcttatctcctgccctgtggtgtacttgtatcttaataaagcatctagagtattcgctacctctagatcatcaggtccagtacatatgtcatcagtgtaataaaccagcacaacattcacaacaatcaagctccattcaacgtggattatgacagtgagccagagaatagatatagtcctaaggttgtacttctgttcccgctagatgaaagtaagctgcttctagtgttctctgctgaatgggaaaaaataacatttggcaaaggaatagctgtatcccaggtgccagggggctatgttgatttgctgtaggaaaacagcatcatctggaatagcagcttcagttcgaatcacagcctgattaattctacaattacccactactaatctccagactagccagatgggttaaataaagatgtgatatgagtaactattcccgtatcttttagggtaccctgttctcactgccagagaaatcgaaattgttcctttcatggaaacccatcttagcttctctgcactctagcctggggagaggagagaatttgaatagcaagtgatttttggcacctgcattccctttgtggcttccccatttattttttgtttaaaatacactttgtttcacagttcattaacttctgtaaatcttataactacaaacttgtgaaaataaatgcctactattacagaagagtttctatctcaatttcatcatgatgagtcaaagtgactatgcatctaacttatttgctatgaaaagaaaatttgaaaagaaaactctggatcatagacaggcaggggaaacagcttcaaatgtgtgtgagagtcagtaatgaggaaaaggactgcaccttcctatatctcccacctcccacccacctcttgatttaataaatctaagaagtatgtgaattaaaggcctggagtgccatggcacaagttcagataggggaacactctttttcctctataggcatccataaacgacttctctatgagttaaaatcatctaattttcatgtggaatatgaaatttgactttattattatcagtgatagtctttcatcatatccattattgttgtatttaaaattgcccaaaattggtcaggtatggtgattcacacctgtaatcccagccctgtgggaggatgaggcaggaggatcccttgagctcaggagtttgagaccagcctgagcaacataggaagacctcatctctaaataaataagagattgcacaaaattgttgtcataagtccaaatcaaacacttctcaattcattctataaagccagtattactctgatacttccaaaaccagaaaaagttaaaaaaagaaggctacatgccaatatgcctcatgaatatagacacaaaaatccttagaaaaatactagcaaatagaatccacaaatacataaaaataattatacaccatgcatctcagagatgcaaggcttgttcaatatttgaaaaccaattaatgcaatacagtacattaacagacaaaagaagaaaaatcacatgatttatcagttgatgcagaacgagcatttgacagaactcatgacaaaaactctcagaaaactctcagaaaatgggggaatttcctcaatttattaaagaacatctgcagaagacctacaggtaacatcatacttgctggtgaaaacctggacactttcctcctaagactgggaacaaggcaaggatatccactctcaccacttgtattcaacatagtactaaaagtcctagttcagtacaataagataagaaaaagaaacaaatggcataaagattgggaagaaaatgtctcaatttgcagaagataattgtctccttagaaaatctcaaggaatatgcaaaaacaactcccaaaactaataagtgagttttgcaaggttgcaggatacaaggtcaacacataaatctctttatacgatttcaaggcttattataaagctacagtaatcaaaactttttgtattggtgaaaggatagacatatagataaatggtacggaatagagagcctggagataggctcacataaattcgtccaactggtttttgacaaaggtgcaaaagcaattcgatggaggaaggatagtcttttcaacaaactgtagcaactggacgtccataggccgaaaccaaacaaaaaacctcaacccaatcctcacaccttatacaaaaatgaactcaaaatggatcctagatttacatataaaatgtaaaactacaaaacttttagaagataaaataggagaaaatctttgggacctacgacctggtgataagttcttagacatggcaccaaaaatgcaatccataaaagaaaaacttgatgccaggtgcagtggcttatgcctggaatcccagcactttgggaggccgaaacaggaagatcacttgagcccaacagtctgagaccagcctgagcaacaaaggtagacggtgtctctacaccaatattttttaaaaaaattagccaggtgtggtggtgcacacctgtagtcccagctactcaggagattgatgctggaagatggcttcagcccaggagattgaggcagccatgagtgacagagcaagacctcacctcaaaaaaaaaaaacaaaaaaaaaaaaaagaaaaaagtgataaattggacttcatcaaaattaaaacttgtgctctacaaaataccttgttaagaagtataaaaagacagccaggcatggtggctcacacctgtaatcccagcactttgggagaccgaggcagatgaatcacctgaggtcaggagttcgagaccagcttggccaatatggtgaaacctcgtctctactaaaattacaaaaattagctgggcgtggtggtaggcccttgtaatcccagctactcgggaggccgaggcaagagaattgcttgaacctgggagacagagacagagacagaggttgcagtgagcccagatcatgccactgcactcaagcctgggcaacaaaactggaactctgtctaaaaaaaaaaaaaaaaaaaagtataaaaagacaagctacagactgggagaaaatatttacaaatcatggatctaacaaaggactcatatcaagaatatataaagaattaccaaaaataaacagtaaaaaaaatccaaatagaaaataaacaaaagatatgaagagatatttcactgaagaggatatacaggtatcaaataagcccatagaaagaggttcagcatcattagctattagagaagtgcatattaaaaccaccactacctactcatctaaatggcaaaaaaaaaaaaaaaaagtcagctggccgggcacagtggctcaagcctgtaatcccagcatgttgggaggctgaggcaggcagatcacctgaggtcaggagtttgagaccaacctggccaacatggtgaaaccctgtctctactaaaaatacaaaaattagccaggcgtggtggtgcgtgcctgtaatcccagctaatagggaggctgaggcaggagaatcacttgaacctgggaggtggaggttgcagtgagccaagattgagccattgcactccagcctgggtgacacagcaagactctgtctcaaaaaaaaaaaaaaaaagtcagcaaaatccccacattgggccagccacggtggcttcatgcctgtaatcctagcactttgggaggccagggcagaaggattgcttgaacctaggagctcaagatcagcttgggcaacatattgagaccgtgtatctacacaaaacccaaaaatttgctgggcatgatggtgcatgcctgtagtctcagctacttgggaggctgacatgggaagatgacttgagcccagtaggttgaggctgcagtgagatgtgatcacaccaatgcactgacagagtgtgagactctgtctcaaaagaaaacaaaacaaaattcccacaatgatttcctgacctacagaatgaggccatcatgacagaaaggcccaagtggaaacccctagagtttccccttctcacaaagtgtaaatcaaaacaaataataccacatacttaggagcaatttcagaaattagttccctcatcaaagacttgaaaaatgcagggaaggaaattcctatcacaccctcatttaattcatccgtttggcctgcacagcaggtggttaggtcttggtgaacgtggcagttttttttttttttttttttttttttttgagacggagtctcgctctgtcgcccaggccggactgcggactgcagtggcgcgatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaacgtggcagttttaaaccaggactccagaattcttaacactcctcccactgagaggtggggttaatgttccctccccctgaacctgagcaggcttgtggctgcttcaaccatagactgcaacaaaaatggcatgatgagacttccaaggccgagtcataaaaggtgatgcagctttttgcctttttcactctaacccttgctttggaggtcctgagccaccaagtacagactccagctagtctaaggctgccacgccataaagagaggctgtgtgtagtaggtgctcaagttccagtggaacccagccttccagccatcctagtataggcaacaggcatgttagtgaagaagcttccagaagattatagcctccagccatcctgtcacccctatccatcaagtcatctcagccaagacctcagacattacagagcaaagagaaaccattctcactgtgtcctgtcttgatttctcacctgaagaacctgtcagcacaatgaaatggctgtttaatggcactaagtttggggatggtttgttatgcagcagtagaaacctaaactgtggacattaaacgactgtggattactgaaagcataatcaggtggttatttcaagtgctgctacggttacaggtgtgatctatttgctaaaacaattccatacctcttccaacattctgtaggcagccgttgatctggccaatgataaaatggcctgttgaagattctgctgtgttcctagttgggacacaacactcttgtgaggatctggaccatacgctgaactagaaaccattaaatggtgcagtttttctcatggtcagaatataagaggtctggaaaacagagttgaggtggggaatggcatatctcacagacatgctgaataatctgccttcagaatttttgcttctcaacctcatgactttgtacctggctggtttagattctagtacccaagaaaaacatgcttccacttatgagaatcgctccactaacttgcaaacagagccacttggccacttctggctcctcattgccattacccaatcctcccctctccagctgacttccagttacaactcgttgcccagaattgtgccgcatggccaccctaactgcaagagaggccagtaaatgatgtgacaaaggatctgactggcttagagcgactgtgatgcttgccctgctgctgggcacagtgctgtcctggccaaaactggggctctgttatggagaaagaagaggaaagggatgtctgttaggcagccaactaacagtgcttaccacacatgacctagtgaaacgttttagaagcagtataaccctacaggacctgagggcaggagagcaggctgggaactaaagagcatccatgcagggcattgttaggggcttttctcttagagtacaaaaagatatttagagctattgtttcacatgcctttctttaaatgtgattttcagtttttacctctgccaacatccactaaagtcttatttaatggtataacttggtgtggtgtggtgctgtgaaggtgagagatgagacataaacaattttgaggcctacccttaatgttcactcaccccactctttaaacctgttctttattgagtcccacagtctataatacccttccaataataacagtctgtttcttgtacttccaaacaaaacatttctaagtggcacaagatttggtactagaagcaaagtcttccatgagtcttgcattcagacaaatgcaagaattttgttttggttacctggctagatgtggtgaaaacaatgtggtgaaaaataatctgggatgggaatctagtagcttacagcatttattagcaaaacacctccttcaatccttgtacactctcacctgaactctatcgtccattgcagttaaagctctgggataggcttcttggtccaggcatcacctccacatgaacctctattccagcgtctataccaagaaatcagcctgatttaaaatgatcttctctctttttgggtcaagaaccttcacatatcatttacataaatattacctgtttcctggtacatgtttgcaaactcctactactgttttcatatgcaagctttctcctgctgcatgacttaaattgttcagttgaggcaatgtagaggttaactctagttacaggcctggagacattggggtgggagagtaggagggaagtgcctttgcttccctgctaattccctcatgagacagtaagggaacctgcaatcagataaacgtgggggttgtttaacaatggaggctcagtaagagttggggattctggggactcccaattctccaatttactcccatttcaaatcccagtgttctatgcttttctgatcgtggccccaacctttactaagagaactgagaaggctgcgaactcactgagttttgtaatttggaaaggtgatgggtcaaaattttaaagtttggtttttagttgttttattcttgtgcctgtaaaagataagtaattccttaagcattgttatagaaattccctctgtgacccaaaccaaaaattcgaggaatttggctgtcatttagatgatcccaaaccatcatgagtggccatcctatcccacaattcttgaaatcctgtgcaaccatcaccaaaatgtaattttagaacctttttttatcacctcaaaaagaaactctgtgcccattagcagtcattccccatgttcccctaaattcctaggccaaggctaccactaatctgctttttgtctctagatttgcctagtctggatatttcctataaatggaatcacacaaaatgtggcctttggtgaatggcttctttcactcagcataatgctttcaatgttgtatccatgttgtagcatggatcagtacttcatccctttttacggctccattgtatgaatagaccacattttgtttatctattcatctgttcattttggttgtttctaccttttggctattgtgaacagttcttctatgaacatatgtgtacaaccatctatctaaaaatccattttcgattctcttgggtctatacctaggagtagaattggtgagtcatatggtaactctgtgtttaacctttcaaggaattgccagaccattttctaaagtggctgcatcattgtacttgatggtactcatggtttggtcagacaacacccagtttatcatgggcaggtcaggtcttaagaccacatgtatcacagtcattccgtttcagtaaataattacagcaagccaggagcttttcctcctggcaaattattattttttgtgtgtggaggtcttagctttaagtttatttcaaattccagagggctgaactgtgagtctcttattaaagcttggaaaaggctctgtgtagcatcctaatggggtatgccatctccagaaaatggcccactgagtgtcatgcttcttttttagcaagcagagggttccaagtaaggcaacttgtctttctctttggagggaccgtctcaacatgcctcagcccactgcatgcccaggaagttcactgaggtatcacctccctgaattttcaaggggcttctctctcaccttgtggtgaaatatttgccacttcctatgcatcaggtccactcagcatgatgtcttggggtacagtgagatgatcaaatcagttcccagggactcaattatgataatgtgccagaggcttcctttgttctttccttccattatcaccctcagtccttgagtcaggaagcccctctgggaatttatccagctaccaattgtgtttattacaagtatggattcaagaaccggggaaagagccacagggtggctgatagtgaaagggacgtgggctgactccacttctgaccattggaccaagtggcattctacttccccagtgattcacacgggctagtgcaagcccctggtaaatggccacgggtcccacgagaagggaggaggcaggctgaaagtacacacttgtagcgttacatgtgcctggcctcacctttacaggctcacctcacgggctctggcctgtggactgactagatctgggaattagatgaggcaccatgattttccattgtggtgattcaaggcagaatgcctttagccagacctagagttaccggggttatacagatcatgatggcttactacaggacactgtgatcaattagacaccaccaaagatccctggggagaaatcagtttggttccagcttccagccctgctgcctatcatgatacccaggctcatcctgtttctatgagatttagtgccagtgctttgtctctgctgtttggcgtgaagcccggtcgtagagttcaaattgaggtgtgctgtgagcataaacgcacacaccggaaagtctttgcggggacaaaaaaaaaaaaccaatgtaaaataccccattcatactgttgtgttttgcctatatgtggaaatgataatatttcggatacgctgggttaaaaaaattcattataaatcattttcacctttttctttttactcttctttcatgttgctgctggaaaatttaaaagtcaacatgtggcacgcacactactcctattggccatctgctctagctggatgggaactgcaagcagcaaaggcctttcaacctctccgagcttcaacatgttcacttatgcatcaggactgatccaacagcaacctgaaagggtcggtgtgagaaagcaaagaaagaggtactgtttacggagcgttcagccgtgagcccaggcgcaggcgcggagctaaacccggaggtgaagcaactacagctggggccacgcccacagactccgggctgtcggggcgggcggcactcgcgcttccagcctgggccaaccaggctgcttgaggctcgaagcgcatgcgcggtctcgccctccgtactggccgagccagcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgacttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggaggctgaggcaggagaattgcttgaacctggagaaggaggttgcagtgagccgagtttctgccactgcactccagcctggggaaagagtgtgaccgtctcaaaaaaaaaaaattatatatatatataaatatgtgtgtgtatatatgtatattatatatgtatgtattatatgtatgtatattatatatatatagtacacaaggttataagtggtgcacccgtagaggagggcacttaccatgaatggagcttgctgagctggaagttgccctggttgagtcggtgactgaatgtgaaggcctcagacattacactactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgttgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactgaaagatggcaccataatagttgaaaaaactcagtcacaaaacagtggacaacataaatgtgatgtcctctccttatcaaaccattggcttctgggtgaatgtaaagggaggggagaatgtgatcaaaagaggtctaggtgagtggagatggtatgaggcagatgggtgcattgggtaccattgaacctctggagaggtagccttaacttgtacccactgacctataaattctgcaccaagacttttgtgtgattggttcaacagggctcagtaatcttgttttcaagttctttaagagcctgttattgcctggatctccagtaaatctgttctttctcctcataaggaggagagaggagtaattaaggaatgccaaggctatttttatgtttcaaatgaaaatatggaccacgtgcggtggctcacacccataatcccagcactttgggaggccgggccaggcaaattgcttgagctcaggagtttgagaccagcctgggcaatatggtgaaaccctgtctctattaaaaatacaaaaattagctgggcgtggtggcacgtgcctgtaatcccagctccttgggaggctgagaatcacttgaacttgggagatggaggttgcagtgagccgagaatgtgccactgcactccaccctggacaacagagggaggttctgcctgaaaattaaaaaaaaaaaaaaaaaaaaaagaaaatacttgtgagtctctagaacctgaaaacctgaaagtcttctttactacttttgagtcgtgtgtaatgtgcggagagtggtacctatagcacagtgaggtggctcttctgagtaccactcatgccccttgcagctagtgggctataagtgtcatccctgtttcctggtgtcaggccccactcccttgttgtcctcctttactctggtgtgggagtggggtggagggcagcagctgggccccttacacttggtgccatctctgcaggtaaatgccatctgctatggggccaagattatgcttccaggtgttcttcgatatgaggacggcattgaggtcaatcaggagattgtggttatcaccaccaaaggagaagcaatctgcatgggtaagaggggatgtttattttttaaattctaaatgtttgtggttacatactaggtgtatatatttatggggttcatgagatgttttgatacaggcatgcaatacataataatcacatcatggagaatggggcatccatcttaagcatttatcctttgtgttacaaacaatcctattttactgttagttatttatcaccttagttattttaaaatatacacttaagttattattgattatagtcaccccgttgtgctattaaatagtctcactcttcttgttcattcttttggttttttggtggtggtgttttttttttttttttttttttgagacagtcttgctcttttcacccagactgcagtgcagagacgtgacctcggctcactgcaacttctgcttcccaggttcaagcgattctcgtgcctcagccttccgagtagctaggattacaggtgcacaccatgacacctggctaattttttgtatttttagtagagacagggttttgtcatgttggtcaggctggtctcgaacttctgacctcaggtgatctgccctcccaaagtgctgggattacaggtgtgagccaccatgccgggcctgattttttttttttttgtacccattaaccatccctacctccctgccagccccccactaccctcccagtctctggtaaccattcttttactcttctctgtccatgagttcaattgtttcgattcttagctcccacaaataagtgagaacatgcaatgtttgtctttctgtgactggccgattacacttaatataacgatcttcagttccatccatgttgttggaaatgacaggatctcattcttttttaaggctgaatagtaatccatcgtgtatatgtaccacattttctttatccatttatctgtcgatgggcacttcggttgcttccaaatcttggctactgtgatctctttgataacactgatttcctttatttggggtatatacccagcagtgggattgctggatcctatggtagctcaatttagtttttcgaggaacctccaaactgttcttcatagtggttatactaatttacattcccatcaacagtgtacaaaggttcccttttctccacatccttgccagcacttgtcattgcctgtcttttggatataaaccattttaactggagtgaaatgatatttcattgtagttttgatttgcatttctctcgtgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtgatcatggagagagacacttaccctcggaagtggggtttaggtccaaaggtaagtggtactgggttgcgtgccctgccaggttcttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtctgtgtccctgattacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtgatgcttttatgtttgttttctggtttttacatttttgttctgtatcttacacaatccaccttgggccctgtcatctgatgtgagatcaagtactcagaggcagtgattaccacaaaaccactgatctctagaagaacagagaaggagagggttaatgtatttatacatagtgggcctggcaggagcggggggcagggtgagtcgggagaacgaagctgagggtggggacatgcaggaatctgaaggccttggtgacagattagtggaagaaaggtctagggttgcttccgatttggtattaagaaccaagaaagaggccgggtgcaatggctcacacctataatcccagtgctttgggaggctgaggcgggcagatcacccgaggtcaggagtctgagaccagcctgggccaacatggcaaaacccatctctactacaaatacaaaaattagccaggtgtggtggcgtgtgcctgtaatcccagctactcgggaggctgaggcaggagaatcccctggaacctgggaggtggaggttgcagtgagccgagatcctgccactgcactccagcctggcaaaacagactgtctcaaaaaaaaaaaaaaaaaaaaaaaaaaaaaagcgctcttggatgcagcgaggcgaggccctgagctgtagccatatcatgagccaggcatgcagggtgggccccagccctggctcagcgaccggcctccactgtaccacgggaccccaggcttggattttctctcgttctaaatatgtgcccacaatgagcgctccactagctacaacaaccttaagggtgtttttctacatgggcactagccagtagagccctgcagtgggggcagagaatggggactcttccagggcaccagtgtttatcatctgaacacaagagaggcatcttgtgttaatgctgttgtccaggagcttaagtgaaatgggccacatttctttttgtgtggaaacccagagttacaaggtcattggcatttcaacacagcatttttattgcttttgaaggtttccctagagcagacatcattctattgcacagatgtgtcattttggcattatagaaagttgcagttaaaaacgctttctccaaaataaaaagacaaatgaaatacccagcatatacagttgaaggcaaaggagggcaggctttagagggatggggtccattgcttttgctgtgcatcacccttgattagcagttacattttggtagtacttcttacccccaatttctagaaatccttttcaaatccagatcagtggggccccatctatcaggagaatcaacccttcaggagcctgagcaagaagactgaaccttactggctgaattaggatagctgcagagagctggaagctgacacaaaactagttggagcagccctgtttgtcttaaagcaaggcgggtggaattccaaatgctggagaggggcatacagtgggttcccccattctacaagcttagtaaacccaggagacaggcacccactgtggagaactgcacgcttggtcgaaggcttcttgtaatttcttaagggtttcatcaacaccattattgaccagtgagaggtcaaagtagtgagcgtactggctgcggatggcctcagagtccttctgcagctgctgcagggcttctgtctgcaaagaagaaagccacagatgaagcaagctgcaccacccccagcccagagaggccagtgacagattttaaacagcaattgttagcgttgctcagctgtgcatcatacttgacgagtcaaattcagaagacattgtgaaagaatgttaatgtagggcatgaagaggcaatctcaaaagaccatggcaattctcagaggatctcaagctaaccctgactaatcagagtcctctggaggaccaatagctatgcagagacagcatggacttcaccagcatctcccacttaatgccctttgaacatggaagagccatttcaacaaccaccagagctgcaatcctaaaacgaagataaaggtgattttgttgttttgttttgttttgagacagtgtcttgctctgtggcccaggctggagtgcagtggcacaatctcggctcactgcaacctccgcctcccgggttcaagcaattctcgtgtctcagcctcccgagtagctgggattacaggcatgcgccaccacatctggctaatttttgtatttttagtagagacagggttttgccatgttggccaggctggtctggaactttagacctcaggtgatccgcccgcctcggcctctcaaagtgctgggattacaggtgtgagccactgcacccagtcagataaaggtgacttctaatcccagatcacacctgtaatcccagcactttggaaggccaaggcaggatgattgcttgagcacaggagttcaagaccagcctggcaacacagtgagaccccatttctacaaaaaacaaaatttaaaaatgtgtgtgtatatatatctcaggactctgtctttgacctaaaaccaagcagccatgaaagacaaatcatgtaactacataaaagtaaaaatgtctgcatagcaaaaagacatgccaaattggaaaaaaattgcagctgatattacaaagggctaattaccctaatatagacttcctataaatcaaaggtcaataactcagcagaaaaatgagctaagggtatgaccagataattctcagaaaaggcaatacaaattgctcttcatatgaaaaagtacctgatcatctcttttagtaaaaaagaaatatgagatactatttttccctccagtagactggcaaaaaaagaaaattttgacaacatgctgcaggcaaagagaaacaagcagtctcacaggtggttggcggtccctgtccaaattctaagtgtgtgtgctcttggacccagtgatcctacttggagtttttcctacagatatatttgcacacatgtgctatatgcacagggctattgactgcagtattacacatgcatgcagcagaagaccaagcagctatagagaaaaagagttcctcacaccctgatagggaaaggtgtccattgttcaatgcaaaagcacagtgcagcaaagtgcatgggtagggctgggcagaggagcagggtaggctttttgatatattcctggcctctctgtctttccccacagccatactgcaccccagggcgggttcagtgccacctctgtccatcacagcttcccctgccagagcctgcatcccaccagtatcaggatctgctcaactgtccatctctgcccctggaactgtgtgcctccaggacgatgactgggtctggtttgttttgtccctgttaggtagcatgggcactggcctagctagtggcttaagagctggaacgaatgtgcataccctttggcttcttggccctggaggaagaagcccagctggagctgtgacctccagccagcactctggccaatgacctggactgaggtcccagtatgggcaggcccggagaaagtgaactacccatcgcgcacaacctctcctcacctgagtgccctggtcagtaggtgcaatgaacacaatgaaaggcgaaagttctgctgtccgaacaattttcagggtctagaaaaaaaaaagaagggcggcggggaggggggggaaggaagaaaaggaaagtgaaaaaaaaaaacctacatagctgtcataatggattccttctaataagcagctttgagctttaccccaatacaactttccatcattcccagtactactgttcttgttccaggctgaccccattaaaaggctgaagcaatcctgagcccccagaagattcccaaggagcactgtcttcgccatcccttgtgtggctgagcccatctgtccctgcccttccatgcctacccacctggggctcaatgtcaaggatggcaatcttgttctgcttatggatctggtgcactgtttcaaatttggtgccaaacatgttgccttggtagctgccaaactccaagaactcattggcagagatgttcctcgtcatctcctccgttgagataaagtggtactccttcccatcttcctcactcttccttggcggccgtgttgtatctgtgtacaagaacccaaatccccgacaaactccaggtcctcaccctttcatgagggcttggaccatggtgtctgtatggaaaccctagctgcctttggtgcattgactttaatacaggggttcctcccgtgggctcctgaagagctgatgctagaaagtgatgcacaccaggaaatccctccatctgcccaggacacatttaatttttaaggggcaaagcctaacatagaaaattcctattatcattttccctaaatgaagttacatctctcaaactaccaaatctaggaatattgaaacttagaaatgaagatagcggaaaatattttaaaaacagatctacagactatggtcaggatttcttggaaatatatttaaggtttccttttcatgacttggaaagaagagtactttggtttagtttcagctcatgttgttaaaagttggactattttctattactcatataaattgtctaatcagtaaaatatgctccagatattgtagcttgaaacacaatcctcccaacctcccctctttccatcttccattgactgtctcctttgccttccggatcacacttgtctctcaactggccccttcccctcaatctacaaccacatgtgattctcttgaaggaggagcctgtactggttatttctgcttccccactcactcctggggccatctctttctgctcctaatgtgacactggaataactcttatgtccctccagcaacgagacaactctcaatgatccatgtgtaaaaaagcaaaatgaagaaagaattaaaaaatagtaatatgaggtttagaatctggttttctattttgcttagcagtacagtaattcctcacttaatattattatcagtaggttcttagaaaatgtgactttaagtgaaatcacatgcagctggtcgttgactaacatggtttagttcaacttcatttcattgtattgttgatgagtaaaaaaactggttcttgttatatgtcatttcacttaaagtcacagtcttcgaagagcctattgacaatattaagtgaggaatcaccgtatttctttctgggaacatacacaactataccatgcagcatcacttctgggaatggaagagttatcaaattctccacctgatcactggcgctactcttctccatatctaggactgctgttgagatcgtttgggcctttcctaggcactgctttgatttagaagacattccatgaaaatgagaggcagcctgaacatcaagagtgggatagttctcaaagagaattaggcaaattgcagaggaacatgagaaaatgtttaaaaagtaaaatgacaaagttatatgtataaactttaatacttagtaatttttaaggcagtatcaaaatgtttactatagcttctgttatgtagacaaacagcacgaataacaataagaaaacagttattctgttaggtggaggaattgtgggcacaaatttttatctttccatattttgtttagttttaataatcatttaaaataaaataatttaaaaaataataaaataacactatggtatttcagatggcgagtggtaccagcctgtcacctcccctccaaggtgcctaagagctacttacatgggacagggtacacaaacttctccggattctggctgagcagggcattcttaatgtggctgcgacccaccccactggctcctgtgtagagagagaagaacatcttttggaaaggggggagaggagcgaggataagatacggattttcctctctcggcactcaaaactgccaacaggtgaacatgagttggggttgcatctgggctggggtcaactctaaagacaggaaggtgagcagtccgccagaggcaaagcctacatacctgggtttgaagcaaggacttactctgtttcaggtcagagtcactgcttgggggaagggagatttacaaagcgtatcactgccagcagacagcatgaaacctaaccaaaaataattcgttgctaaatagtagagaaacttgtaaggtttagtttcatttgtgaggtggacccaggtggggtgcacgtgaggattcagaaaattccttacacctgctctatatggagaacccaagagacctcagttcttttcttcctcactgccttttttgggggtgggcacgtgatgcaggcaggaaaacaaagacagaaatgtgcaaatggggcaatgagaagataccgatcagcaccagggtcttcctcttgaatgcagggagccgaacgacttcctcgtaggaaacaacatccaactgatcaaaaactagagacaaagaaaaccaagcagtgttcatttccagagctagggagaacagtggtccacactctgaaatgggaaacagcctcgcgacatctcaacaagcagggaggaagtgactagagatgagacgagggaggttggtgtggaggaaggactttggactgtatttttagtgtggtgagggaattttgagcaagggagtttatctaacttttgcaccctctcttcctccttgccctatctctctgagccaacttttcttgtctcctgtcctcatctcttctccatagtttcagtatcagatgttcccttggcacttagagctgaagaatgccaatgctatctcggttctgcctgaatgtcccttatcttagaagatggtggtgctattgacccagctgctcaagatagagacctggtgtcatcctgactctccacccccttacctgcctacaacccaagactgccacgatcattccctggctggtggtgtgcacgtgacgtctcagaaaagagaaatgcagatggaaagctgaccgtgcgaattctctgctcaaaacccttcaccagctccacagtctatagtgcaaaatttaaaacgctagggagggtgcacgaagctccctatgacctggccctggcctctccctctggcctgtgttcttgcctcacttcccctctcccaccacatctacttctgtgtgaggggtggggtgatgagcaggtgtgggctcaccactagtcctcctttacatccactggcctgactgcagcaagcttgtgaagatggattcaataaaaagaaaccagaagaaatgacatgctttctgtagaatgcgccttctgctgcgcactgcaccacctccccttttctgctggttacagagactgggaaacacgtgaatgctgccaggaacctggggcaagaaggctcagaaagcttactcgagctgtgcttggccagatatttgtctttgtacttcttcttcttcccaaagggactgcagctcggggcttcgctaggagctgactgagccatacttgccactcgcctggtaggaaaagacaatcaaggggtcagctttcctccccctcccctcataccccccccagccactcagtctctaatggcacccccttcactctctgagtgtccattacagtgggagataatgtgtgcaaagcaccccatacactgtttggtgcatcttgcactgtgccctgccctcagtcagggacctggctccttgagtctgtgtcatctagtacctgtcagcacattctggacacaacccacaaacaactctctttctttggtctagaccataaaggtctcaaacctttatgaccctacctcactctaagaaatacactgtacattgcaagccattattgcacatacatctataaacaaaacacatacacacaccccacatatatatctaaaacaactgcttcacaaaacaataacttgtattactacatgtaatatattctaatatttctattcagtgtcaaccccacaatggttgtaatctttacactggggtaagtttgcacaggcagagggaggctcagtgttggatgtcttatcagttggaactgttttgtgaatttttctgccattcctatgatgtaaccaggactaagtgagcaatctgactcggggacaggaattatttcttccatgtaccaggaatgtgcctaaaggacacatacttaaatgcgactgttttctgcaggactccaaggaaatcccagaaacagcatggctggtagaagcgcactagcttgggaaacaggagaccagggagggctcagtcccagcactgtcacgtgcttggtaactatggggaaaacgtttaaggaagcaagaggcccacataagaatgaagagctatttgggctcccttgcctgtggttgcctctcagtccagcttatcaacgcatggttaaccctcccccacccattatgccaggaaatctaggaggtctccttggttgagaaacagaaactacaaacaaaatgacagattttctgaagctaagttatttgtggcaggcacatggcccttccacctgcacaaaaatggctcaccattcctgcagctcaggggaagggatcaatcctgctgactccttggaggagccttccacccgtccctgccaccaattgctgtcatccttgttgataatctggataatgtccccagtagcaaacttcagtcccgcctccttgcaagggatcagattgtcctttttgggatcatagtcaaactgcgctctcatgaacatctaaaaagaaggtaaaaggaactgcaggcggcagcttcaaaagaaacaccagcatcagagcatgtcctgctgtagacaaatggggtcaggatggaatgaacaacagggaggtaagaatggtgggggagcacccaagaaagagaaattgaaacgctgaagtgattgtgtttgcggaggggtcagaatgaatccctttaacaagaaggcatgagaagccaggcgcagtggctcacgcctgtaatcccagcactttgggaggccgaggcgggtggaacacatgaggctaggagttggagaccagcctggctaacatggtgaaactccgtctctactaaaaatacaaaaattagctgggtgtggtggcgtgcacctgtagtcccagctactcgggaggctgaggcgggagaatcgcttgaacccgggaggtggagcttgcagtgagccgagattgtgccactgcactccagcctgggcgacagagtgagactccgtctcaaaaaaaaaaaaaaaaaaaaaaaaaaagaaggcatgagatatctttccacgtcaacgtgtccacagttactgctggatctgggtcgtctgtctcagtacagggcagctactctttgaacaactgttttcacaattgaaaatatggacactcatatctatcaaagaacttgaatttattattgaaaattctcctctcctgctcccaaacacacacacacacacacacacacacacacacacacacacacacacctacctcattacttcattgacaaattttccaagcatcatttgaagaaagaaggctaatctcatacgaaaacagattatagaaaatgatggcacttcccaactcattataagcatgatacccaaatctgacaagaatcttataatttctctctgcaacagagatgtaaaaaccccaaacaaaatatcagcaagtcaaatttagttatgtataaaaagtataataaatcacaaccaaacaggatctagttcagcaatataagaaggtttactacctgaagggcaataaattcaccacgttaacataaaaatggaaaaagatcatatgatcccctcaatagatgcagaaaaagcctgtgataacattcaaaacccattcaagattaaaattcttagcaaacttggaatagaagggaggttctttactgtgagaaagaatacctacagaaaccctacatccaacgtcatacttctcagtgaaagattaaaagctttccctgcctttttcaaaggacatgggtcttgctatgttacccaggttggtctcgaactcctgggctcaagcaatccacccgcctcggcctcccaaagtgctaggattacaggcgcatgccaccacacctggccagctttccctttaagatggaaaaataaacaaagatgtctgctatcatcacttccactgggatactgtgaagatgcctcttttatccaaactgatatgtaggtttgacacagggataaacaaacagtccaaaagaaaagaataaaaagttccaaaatagacctgtaaatattaccatgacaaaagtgacagtgtacagtaaatgatactggttcaattggtatccatatggaaaaactggaatcttgacctcttaccttacaatgtatataacaatcaatcccagatgggttgtggatccaaatgtgaaaaatcaaacaagtaagcatttagaagaaaacacaggagaatatcttgttgaccttgtggtaagtaaaaacttttaaaacaagacataaaaagtgctaatcagaaaaaagtggtagattggatttcattaaaattaagagtttctagtcattaacaggaaccatgaagaaaataagccacagaagaagagaacatacttgggatgcatatgacaaaggactcttatccagaatatatgaggaactgctacaaatcagtaagaaaagccttgaattggtatcttacaaaagaggatatccaagtggaaaaaaacatataaaaaggagtttaccctcattagtcattagagaatttttagaatcacaatgtgataccaccatcaggatggccaaagggtgaaaaaaaacccaacaaatcagacaatgctaagtattggtgagaatacagaacaaccagaactgtcatactgtgcagttggggatgtaacatggttcaccaactttggaatactatttggcaatatcacctaaagatgaagacacatatatcctacaacctggcaattctactctcaaaagaaaggcatagatgtatccacaaaacacatgcacaaaaatcatatgatttttctccatttttctgttaacgtggtgaatttattgcccttcaggcagtaaatcttctcatattgctgaattagatcctgtttggtgaatggcagccattcaatgtaagaccaaaaaagctgacagaatagattaaattgtagcatgttcatacaatgaatgaatgagaatgaagcaatatagatgattcccataaacataatactgagcgaataaaataagacaccaaagaattcatactgtataattcaacgttaatacatttcaaaagggggcaaaactcatccctgctgttagaagtcagggttatggtgggccttgaggaaacacgcatggtgagggggcggcggtcttaggcatgggtgtactcagtttgtgaaaattcatccagttttatacttgtgatttgtgccctttgttgaatatatgcccatatatgccaaaactgcaatttaaaagtttacttaagaaaattataccgtcacactacaagtaacctgcaatagaaacttcagatttattcttttaaatatctccttcttccacattgacttgccatggccctgtccaatctattcctctactggctgatgagctatgtgtgaactgggaaccatttctctttatatcacctccatgttctagcacagtactttgtacatggtagaccctcaataaattgtgaataagtgctcaacagattctatctatcttttgtttctttctttactttgccactatcaatcacggggctttattattgctattttaaaaagtatttgccaatttgcttggtgaaaactggtgtctcatgcatattttaatttgcatttctttgatgatcggtaagataaaatattttttcatatgttcaatgctcatttgtagttttcctcctgtgaatgatctcttcattccctttacccattttcctcttggagctgtattgattccttaccatctgtagaataaaattaccctctcccttcctacctgaccactagcagcaaaggctcattcattctctactcctgtcgtcactatgttctccattgaggaaaggggaatgagctcctgtattttataccaggcagggaataatgggaccctgagccaagcagctacacacttgcgagatacttagaacttaaagttagactcacatcccttataatcaaatttcaaagaatataagacaacatggcccgactcctgccatcatgacaacagagaaaatggtgccacccacctgtagtgcaggaagacggctttgctggttgggaattacttttaatgagatcattcctttggtttctttctattaaaaaaaatggacataaaattgtacagaaaactaagttgaatgatgtgatcattcattcaaagtcccaggtttttttccccaacaaccatctttacattttgagattttgtaggacaattcctcctttaatacaaaagtgtcatgtgccccataaatcagcataacaatatgaagacatgcaaagagtaacaaagaaaagctaactaaagacttttccgagctgggcacggtggctcacgcctgttgtaatcccagctctttgggaggctgaggtgggcgcatcgtctgaggtcaggagttcaagactagcctggccaacatggtgaaaccctgtctctactaaaaatacaaaaattagccagcgtgatggtgggtacctgtaatcccagctacttgggaggttgaggcaggagaatcgcttgaacccaggaggcggaggttgcagtgagccgagatcacgccattgtactccagcctgggtgacagagcgaaactccatctcaaaaaaaaaaaaaaaagacttttcttccccattctttaccccaaaaagtcctgaagaagttcctaaaaatgaactatggcgcatatatatccacgcctttccccataccaacaaaagcattacaaatatttacatacattatgcatacatatgtattgtttgtttttaacaaaaatgggattctactatatacgttatagcttgctttacttcatttggcattacttcatggaacaccagattgatgctctgggttatttgccctgctttagaattttactaaataaaggcagaaaattatcatttcttacacagattaaagactagcagtgaaaagagccccctcaagaaggtacaaatactttgacagagagatgaggtcactgataccaatgtggatcaacacttatggagacaatggaaggtcttcatctagcatagaaaatacccaccatcgccttctgcagctgatccactgaatgatttgtcacatttgtgccattgatttctaggatctcatcccccacgtgaagggagcctgccatgaaatgaaaaatcaatccacaaaagaacaaaagttcaaacaggagctgtcaatgtaactcaagataccatagaagagaaaccaggatttacagcatgttatgaaacagattgtgtcaaatactcaggattgaaaacatttgacttgacagtttaagatggtctcatcctccttggcctcagtagtccaacagcacaataaaacaccttgtcctcaaattcctggaactagagtggctactgactccagactatgacacagatgtatacactaaaaagaataacaaagcaaggcaaagaactcagtactcctctttcaccagcaagctccatgtttctttgttgtttagctcaaaccccaaaatgctaccaagtggtactgctgtcctttccaagtctaatgcaatgggtggcatgtggcaattgctcaaatattaacttactagaaaaatattggtataaataggtgtgaaagaaggctcagatagggagatggtggcactgggcaattcacatagagatcttatcatgtactgattctacagagccagttattaagccacaaaaagtctcttggcacactcacaaaaatgctaccagtttggaggattataagcttcatgccccacaccactgaacagggagtaaattattaatccctgaatcaaaccccacccagagctcccacagagtaccttgtctatggatcatgccaccatgaagaattctggccaccgtacaggactgtttttcattcagcttcagcgtgattccctgaaataaaggcgacggcacaataagctttattttaagctctttctgaggttattttagaaagaacttacggtaatttctcaggaaaatattttccatttatacccaggatagtcctcaactagaacaggcatgaagcctgctttgaggaggaatttgagataagaatgaaaagacaattttggggttggccaattccctaactccatgagcagcctcttgcattgactcttctggcccagtgactcatggggcagagagtaactggtgggcgacaatatgacgggggattaccatgggctcttctgtgaccttctcaaactgtatgagtcgcactttccgcacctcctgtcccttgacctgggcagggctacctggggcaggagacccgttggtgtacatgtcctcggtcacagtattcaatggatgcgatacagcctgccaagccaaaacaacaaagcaacgtatgaaatcaggagcaaggcccacagccagtccacaatctgcaattctaacattcaagaggctctgaaaacttatttcataagtttggcctcattcttatttgaattgacatgaagctgtttgtaagctttatttctccaacttaatagacatgtcagccaagtgtggtggtgtgcacctgtagtcccagctacagtcccagggcaacagagtgagaccctgtctctaaaaataaataaaatagacatgtttatctaggttgctgcagaaatattaatgtgccttgatttacatggtgctctcctggatcctgcttggggtattacataatatataacaaaattagaaagattctgaatcctgcggcacctcaggctccaagggtttctggcatgttctcttctcctttgtatttccttgaacaacctgatgctctcggtcacacagcaataaaggtaattcaggttagcatcagtttctcatgaatcaccccttaggctacaaagaacttctacctgtagaattaggcacttaggactgggccccgaaccgcggtgataacaataatacattgccactgtgacttcttcccctgatctcaaagacagcaaagctaaatgagttactctaccaggcagcaaggcctctttattataaatctaaagtaatttaaggcactgtggtaagaagaaagacaaacgacccatgtaatggaacagagagtgcaaaaacagagccacacatttatagtcaggtgacactgcagtgcagcggggaaaaatggtctgcacgataaatgtcataaaaggtcccgagtataaaatgaaaactaaaaagacaaacactttaaaagtaagaagtctattcatcaaaaaactccactgagataagcatagatttagtagacgagacacggagcaatcatcatacaagcaaacaactgacttcatcaaattcaaacatcttacataagaaactagacaggtatgacacagcctgagaataaacatttgcaatatttacatctgacaaaggatttgtatccagaacatataaagaactcttacaatttaataacaggatgaaaagaaccataaacaaatcctgaacttgagccaatgatatgcatgctgaagctttcaggggtaaagtgctctgatatctgaaacttattttgaaataccaggaaaaagaaggtggatagatgggcagtttttggatagaaatgtgataaagcaaacacagcaacatgttaactgtagaatctaggaggtgtggctatatgggtgtcactataaaattctttcatctttttggcgccattccaagagcagccagtactctttaaaaaatattataaaatttaatttttgaaccatttgagagtaatctgaagacttcattctcctttacccatagatgtctctatatgttaggaacgagcattttcaaaactgaaaatttaacattgacacaatattgtcatctgccaaccctttcaagaatgtcctttatagctatatatttcttccccagtccagaatccaacctaggactttttggtcccagaatccaatctaagaccagaatccaatcatgcatttcacatttccttactcttccttaatttggaaaatttcctcagcctttctttttcttctttcatgaccttgacattcttgaagagtacacacctgttattttgtagatgtctctcagtttggggttatcatctgatgttttttcaagattagactgggattttgcatttttggcaggaattccaggaaagtagtggtgtgccctttccagaacaacactactcttaaaagcccaaacctgaaaatagcccaaaagtccatcaacagtagaatggataaactgaagcatatccaagtggataccctacatcaatggcaatgaatggctactgctacaccactccatggtagatcacctgtggatcagtctcacaggtgatcactctcttctccttaaaatgctccttctcagtttgctttgctgttctttcctcatcttactgatctgggtaagagcaatcacaatggggaaaaactatggaaacctctgaaaatgctccctgcccaccccagataaaatattaaatcaaaaatgatatagccacctggaggaggaggaggaggacgaggaggaggaataggcctgaagtgggcttatggaagggtctgctgaaaataggggatagctgcattccagtcacacccagaggtgaccctcaaagacagtagggagggaagatcttcccaataggcagaactgtgaggagtgtgccattcactgtgtggggaaggagaagggtccctagatgggaatagatggtatgcctgagcagtgtccactggcctgcccaaggcctagaaaaggactagaagatgagagagaaggaagtctggagtagaggcttacatcatttctaagggactctgatttctaagtagaaactttgataagatggtgaggtttgggccaggtgcagtggctaacacctgtaatcccagcactttgggaggccaaggtggggagatcgcttaagcccaggagtttgagaccagcctgggcaacatggtgaaactcctgcctctgtaagaaattttaaaattagctgagtgtggtggtgcaagcctgtggtcccagctactcaggaggctgaggcagggggattgcttgagctcaggagttggaggcagcagtgagccatgatcacaccactacactccaacctgggcaacagaggaagaccctgtctcagaaaaacaaacaaacaaacaaacaaacaaaaaacatggtgaggtttgaagtagtattcgctatcaggtgacctcaaatgagggaagtactgagaaagagaaactgccttctctagcaactagaacttcaaaaaactcacatgacaccaagtcatatggcattgctgttataacaaaattgtctaagataggcttatatttaaaaaattgacttatgatacccgggatacaccatgtaggtaggaaaaggaggttctgagggtgatcttgaagatttattgttaagcaaaaaataataataatgtgatgaagggtatactagcttcatcataaacagtgaaagaatgattatattcatatttgcttaaaaatccataaactggccaggttcagtggctcacacctgtaatcccagcactttgggaggctgaggtgggaggatcacctgaggtcaggggttcgagaccagcctaggcaacatagtaaaacctcgtctctacaaaaaataaaaaaattagccgggcatggtggcgtgcacctgtaatcctagctactcgggaagctgaggcagaaggattgcttgagcccgggaggtcaaggctgcagtgagttgtgattacaccactgcactctagcctgggtgacagagtgagaccctgtctcaaaaaataaaataaatgaaaatacataaactatgtctggaaggagacataagaaacagtggttgcttctagggagaggaactgggtggctataagatggggtgagaaggaaattgttttcactgtgtatcaagttataccttttaaattatgtattatgtgcttgtgttactttaataaaataaattagtaaaagaattttccaaagtgattgggactcaggttcaagtacttgtgtggatcttgtcctgcctcaaccttgaccctgtttaagtaagagtaaacgggaggagggaaatagaaacccacaaaaagtcatcagggttgaaggatttctttctctttgttttttttccttttcttttcttttcttttttctttttttgagaaagagtctcactctgtcacccagtctagagtgcagtggcgtgatctcggctcactgcaacctccgcctcctgggttcaagcgattctcctgcctcagcctcccgagtagctgggattacaggcaagcgccaccacacctggctaatttttgtatttttagtagagacggggttttaccatgttggccagactggtctggaactcctgaccgcaagtgatccacctgcctcggcctcccaaatctgctgggattacaggcatgagccaccatgcccggccaagatttcaatagctttccagaagacagaaagcagatggaggaatgaccaaggagagttgagacagctagagcctagaatgtgcatacaggaggcaccagccaaagaggctgggaagattagtttagttgagcatcttgccatcccaaacaagatcagggatatgtaagtgagaagtgggatgttggattggcaaccagttataataatctaaaaaccacttattgatttttactttttagaactcacttagaaacaaatcatgaaacaaataacagactgtaaatatcagcaccatgacaatattaaggtacacatgtccatgataggaagttggcaggtaaaaaggggagaaaaatcgaaaggaagaggcctgtaatcttgttctgttacaaagtggggagtcaagaagtaggatctgcattggttggacaataaatgaaggagtgaatgcattacataaagttccaagccaggtgtggtggcatgtgcctgtagtcctagctactcgtgaggctgaggcaggaggatcatttgagcccaggaggtcaaggctgcagtgagctatgatagcaccactgtactctagcctgggcaacagagcgagactctatctctggaaaaagaaaagaaaaaatctccaaagcagaagttgcaaactgttttatttcgaccacatgtctctgttttgtttagtaaaaatcaggggactccaacttctttttaaagtatcagaagatctggcatcgctctccaggtggccccagctctcacattccttactgatgcctcagccagaagccagtgttggctaccgatcaccctatatctggggtgttatttttctcatacacgagtgctttcactcacttggtccatgtaggttacactaaaagcacgtatacatgatggaaaggtacagacccatgaaaagctaaaataattttgaaaaacaagagagtaggaagactcagtctgcacagtttcaaaacttactgtagtatagtctcagtaaagactatgtggtatagacatgcagatcaagggaacaggatagggaacccagaaacagacccacagagatatgcccagttgatttttaacaaagatgcaaaagcaactcaatggtgctgcagcaattggaaactcatcaccaaaaagggaaatgctgacctgaaccttaccttctaaaatggatatggacttacatgtaaagtgcaaaactagaaaatatatttgaaaaaaatagaagaaacttgtcaggatctagagctaggcaaaaagttcctatacatgacatcaaaagcagaatccattaaaggaaaaattggtaaattggacctcatcaaaatgaaaaactcttgttctgtgaaagcccacatgaagattgtgaaaatacaagctacagaccgggagaaacatttacaaaccacatatccaataaaagactggtatatagaatataaaaagagagtgctcaatactcaacagtaaaaacgaacaatctaattagaaaatgggcaaaaaacatgaacagatatttcaccaaagaggatatataaagatggcaaatgaggatataaaaagatattcaacatcattagccatcagggagaaatgcaaattaaaacaacaatgatatatcactacacatctatcagaatagctgaaataaaaaaatagtgacaatactcataactggtgaagctgagggaaaattgggcatctcatacattgctggtgggaatgtaagtgatatggcttccatagaaaatagttgaacactttattaaaaaaccaaacacacaactaccataaaacccagggatgacactcctggatattcacctagagaaatggaaatttatgttcactcaaaagcctgtacatgaatgctcataacagctttatttataacagccaaaatctataaagaaccaaaatacaggtgaacagttaaagcgtggtacatccataccatggaacacttctcagcaattaaaacaaaaaacactattgatactaaaacaacttgggatccagctcaaaggcattatcctgactgaaagaaagctaatctatttcaaaacatcacatactatatgattccacttatataacattcctaaaatgacaaaatcatagagacattgaacagagtagtgactgcaaggagttgcggggatggggtagggaggaagacaagtgtgactataaagcgacagcaggagagaggcctttgtggggatggaacagttctctatcttcattgtggtggtggctagaggaattttattttattttatttattttatttttttgagacagactttcactcttattgcccaggctggagtgcaatggcacgatctcggctcaccacaacttccgcctcctggattcaagcgattctcctgcctcagcctcccgagtagctgagattacaggcatgcaccaccacgcccggctaattttgtattttttgtagagatggggtttctccgcattggccaggctggtcttgaactcccaacctcaggtgatccgcccgcctcggcctcccaaagtgctgggattacaggtgtgagccaccatgcctagctatgtcatattcttcttatccagctttattacagtgattgctttttacatgtcagcctttaaattaaagactcagcaaagcttactagaggcagaaccattccagctggaaaagttcaagagttgccatcccaaaggttggtctttcagatgtgcttatccaacaagacgttcctctttacgatgactaagagtcactatcacgcttacccagaagttgcaaatgatgactaagaaaaacggaaacttccaacgtggtaactaaagtacacacttgcaacagtaagttttccaaaagcaaagcacaattttctccaccgtgaacttgtccctgagccaccctgtcttcatgagactctcagaaagggagggtcagctctctgtgacctcatcttacagaactccttcaactagtccccatgtctcctcattactgacacatcataggagaaaagatatgcagacatatactgtcagtgacatgagtaatgctgaacaaataataaaggtcaaaggtactagattctatttctcagagttcagttcacaacctccacatcatcctctcaaagcagccaccatcatctgtagtggatataggaggccacagagctatggcaggcctgcccctgaccagtgacaaggcagggcggaagtggctctgttaaggatgactgctgggattcaggaggagccagggaataaacactcacccaggactccatgtctggcctttgttctgcagcctctggcctttaatcagacaaagtgctggagtggcaatgcctgccgctctgaaagccccttcagaggaaacatctgcagcagggttcaaagggcagaggcagttgctcaaaggaagctggaatttaaaaagagatgaaaaacaaacttggcggggggcgggcggtggcgggggtgaatagagcaggggcaactgaagttggctttctaatccaaacaattagattaagtgacagtgaacataggaaagaacaaatatttgctcagcctactgttaggctctttgccaactgctcccacgtggagacttagaaagccaagtccaagaaggcgagatgatgccagacagctgcccagcaagccctggccccaggtgctcgcaaattccctctctttgcatgggcagtatcctattccactttgggaaaaaacaagagaaactgagaaagccaagggtattctgaagtattagaaagagattagcactgtttaaccacaaatgacaggaactagggagagaggaaggcctaagagccaggatattctggcaggtactgtcttaaaatcatacattaaccaggtgctttgcttctcaggtactaaatccatctgggaacacatacatcaacctaaaggccaagtctctagagatcccttcccaacgagctttttctaccccatgctctcagtacacatgcaaaggcttttgcttccactggggaaaaaaaacaacaggaaactcaagtagcaccgttccacacagcagaaacacagggctgcagatacctggcactgagtccccacactgccattaaaccagtgccggagctgtgtgcaaataacaacactcgttaaatcaaatgctcatccccattctgtggtcaatatttgaagacatgaaatggttcagaaacctgtctgagcttaaaggatgagtaagcctcagactccagaagttaaactataagcatggactttggagtttgtgcaggtacatggagagaatgcaggtgctgtgtccctcacataaaggctgcctctgcactgtgcagaatattcagagatgatggcaggtgctaaggaggaaaataaagcagaaaaggcctcgcaaggaagataacttttgagggaaaacctattatgtgttttgttcatgtatatttcttcatatgaaagaaaaaaagaaaagcaagactatgttacgaaagttcctcttcccctcctctggcgtcacttcccctaccccagccaattttggaaatatggctatttagtcttgcctttctacactccacacccagagttcttttttagcaacactgaaaggttagagacaactcactgcttaggagaaaaatctctgcatcaactaattttgtctcccctcttgacactgtctcaggacattattgattgtcacaacttagcggcgaggtattactttttacaacagaattatcagacccaaagtgttaacagtgcccaggttggcaaactccaatttaagggaattgatcttaacctgaaatatctgttcctggtattctattatacttcagtgtcttgtgtagggagaacaaatgagttagaaaagaatagaacgttcatgatgaaactcaaatctgcttagccacaataaaagcagattcttatctgcaaggtatcctaagcccttccagttttgaaaaaaaagtcatgaaaggcccagggcgctggatcatacctgtaatcccagcactttgggaggccgaggcaggcggatcacctgagatcaggagttcgagaccagcccggccaacatggcgaaaacctgtctctatcaaaaatacaaaaattagccaggcgtgttggcaggcgcctgtaatcccagctagctgggagactgaggcaggagaatcgcttgaacctaggaggcagaggttgcagtgagccaagaccacacccctacactccagcctgggtgacagagcaaaactctgtctcaaaaaaaaaaaaaaaaaaaaaaaaaaaacaaaaaacagaaaaaagtcatgaagttcctggaagtgaaggacaggaaaggcagactggctgagaccacaccacatactggggaaattgggcagaggactaaataatttgaaaattacactttactttctagtatcagttctgtgaaaagaaaagccttgaacggaaccatttcctttgcaaaggaaacagcaagatccaagtctgcagcgaaagttctttctcaggtgaaattataactagtcagaagcagagtcagtgatcatgcacaccgtagactcaacctcctgccatcgcagaaggtgccgcactcggcatgcaccttggtgtccgtgcacaggctgttccctctgcccaggtaccacctgccagttacagcctaggtactgcgaaatgcaagagcccactgtgctgggtgcccctccttgctccacagcgctccacagctgcttctatcacatcaccaccacactactgtatttgtttccatgtctgcgtccttccttatttgcctcttagttccagcagcagacctggagtaggcaacaaacaacactgcgtcacactcagtgaccaccagcggggagtaatgctgcatgtgatggcctaagaaccaagaaacaggttttcttggtggaaatttgcctggagcctgacttatctgttaggtgatttttttttgatgtgggataggcccaagagaattttcagggattctcaaccaattgcttcaggtcctggggaaagtgttgcttcaaacaggcccgaagagaaaagcagtattgggaattttacaactacttttatgtgcattaatggatactgctgtgaagaacaaggccagagagagctaataaaattagtttctccattaacctgcctagaccacattgaaaagaaaaaaaaaattagtttatccaaggaaggagatatacttaaataggggagataggctacattcaaacctattgcaaaattacctttagacaatattctttcagtattaaatgtggattataattggaagtgaaactttgttttgaatcggtagcctttttccataaagtgacacctttaaatgaaactttcagcaaaataattttataatttctattgaagccaacaacttcctcacaggttttcctgcttcaaatcttgccattataggaaaactttctgactgctactactgggcaggcagctcctagggagatactgggtcattaccctggatgtcccagtgtggctcaaggtccttgtcaagcattatctcatgtaaatgttgccacaaccttccaaacttgccagtttcataaaggagagaaacctaaggcacagagagcttcagcagcttgcccaaaaccatgcagcaagtgaaaggcagagcttgctgctgcagcaaagactggtaagagccccaaagggaaggtgaacctaaagaaataagaatccgcaggttgtggagtcaagccacacttcatcgtgtgaagagtctccctcagatgctcactttggcacagctggatactatttcattcagggattcagtaagttttcttatttgatcttcttcaaatccgttagtaaaaaccaaacaaattagctaactggtagactatctccaatattacagtataaactcacagccccacaaaacgtgctgtttactcagaggttgtgcccacaacataacactggtggtgacagggcctcttttcaaaaaggcacagtctttcaagcatgcccataagggaacacataggtttacataagaaccccgacacaaaatacatcatactgtaggattctatttatataaaattccagaaaaggcaaatctatagtgacagatcagtggttgccatgttccaggtggaggaaggtgactgactgccaagggtcacaggggaacttcctggaaccttgaaaatgtttattctttgtcatgattgtggttgtcgttacatgactatatacatctgtcaaatgtcatcaaactacacaattaaatttcatgaattctactgtatgctaagtgtacctcaataagacttccagaaataaatagattttttaaaaatagttgaggctcagccaagtgagtactgattgtggggaagaaaaaaatcacaagtccaagtttatggggaatcaggtaacagaacttgtaattttgtctcatcatctgtataacaatagcatctttcatgcctgtattatttctgcactcatttaaactcaggctgttgcaatcctgatttgaaatgacaggcaggtgtgaatgcctcactcgagtggaatataaagggtaaggcaatgcggtgcagcagacacaaaatctagcctcagttctgatgcccattacttgtttccttgagttaatgccacttagcccaaagagtctacagctctactgcttgccttatgttgcagggaccttcagttttttcatctgtgaaatcggagggttactgtaaatcccaaatgtccatctcttcagtcatttattaatttagcaaacatttctgaggacccacttattgggcacttaaagaagtgagtatgacacggccctgccctagaagaccttgcagtctaggaaggaggttcatgctgtgacttctgagcttctgcctggctctctggttctctctggacattttccccttgggacctggccagcatgctgtgaggaagaccaagccacagggagaggctgctggttgattttctggctcatggctcatggctccaaatgagtaagtgagccgtgtccccacctgacagaccctgagtgacgaccaccttgctgggcccaatcaaaacgaaatatgagagacaagaaaatgctcagtgttgtaaaccagcgagtttgggagagatttgccagtaacagataagcacaacctacccttagggcatctttgaggacggaggttaatagctatttaccagccatccatccctggaatctggattccttgttccacccgcaaatatacactggccaccctctttgcaccatagcacaaggggacctgcctaaatgaagaggaacagtgagtgagctctttagaaccagaagctggcttttacaatcatttctgctgacccaaacacaagcacttcaacaacaaccaggcagacctactccttgatgtgttccttaaagactttctgttactctgacttccgtccacgaggaagttttccttgcccttaataagcgcactgtccaggccgctgcctctcctgatttccaactggaaggactgctgggggcaaggatccactgcaccagcagcccggtacgaacccggccgcgcgctggccttgtcctcaccccgccggctatcgcggtctccgacctatggccaggacccgcaaggacaggccccccggggacagggaccgggacagggaaagtcccgagatgaatggccgagccccggcccagcgcccttgggactagcggggcccgctcacctctggccgactacgcttctgcagcaaatgctccaggtagaggtcggagagcgccgtgtgcatgctgcccccactctcgccctcgctcgccttgagggtcatctcgcagaagctggaacactggaacgcaagacagggcagcgctgggaatgacagggcccggggcctgcggggctgcggagaaggcgggagacgcggtgcggctgggccagtcaccgccccgcaggcggtgcgccgggagggcgcggacggagctccgcctacggcccgcccactcctgccctcgctccgcccatggaagtctcccacgccccggactccgcggctccctgcgctccgagaagcggcccttaaagggcctgaggaagtcgtagctgtaggtggccgcgtgagatgaatgccagaaagataagaaaggggagggggcccccagcttctgggtggttgagcacacggcccacgccccgttgggcctgagccgcccgggtgccctggccaaattcgtggggattgcagggaggcaacaagggaaatcagaatcggccggcttagtggagttcaaaagatgtaggtgaactctagactcttcccataaattgatgcgggcgcagcattaccctttgagatctggacattgcgaaaatgcctttaaggctgctgtgctgctgcaccctgtcatttaattgttgtgtgctgtttgatgatgaaacatcttattgccttcaaaaccaaactgtttttacttagggcagatctcctgctgtaaatgccacaaaatttttccggctcagcgaaagcaaaggcagcaaacattccttagtaaccctagaggaggattccttagcatcctaacgcattggagacattcaaacaccagtcacagcgatggaaggctttctgaacaaaacaaacatttaatgggcttgtacggctcttggtcccctaccccaagctagtagcctcacagtattagaagcagttcatcactacatgtaatcttattctgaccttcctcaaagcttcctgggaaggaggagctcatagccaagaggagaaaatccaagggcaacagtttagagctgcattgcccagttttctctaccaagaggccgaactcatgtgaatgacggttcccttcctcaagatcactctaaacgaacggggggggaggggggggtggggtggggggggagagattgaaattaagactgtgatattgaggcatggatagattaattgagcaatggcatagaatagagaaccccgaaacgcaaccatgcaagtatagaaatgtggtatatgatagaagtggcatgttaggtaagtaaacagggacattttattaactgacgctggaaaatggttatttatattggaaaagatgaaattggaatcctcattcatgtgatatggaaaataataataatctattccagatggattaaggaattaaatgtcaaaaacatacccttaaagctcttgacaggaaacataggcaaggaacttttagactttgggatacagatttctaaacaatgtagacaaaccattgaccatagaatggaatagtggtaactttgactttaagaattttaatttatgaagacaccataaagagcaaaaaacacagctgtgcattgggagaaaatattttcaatacagataagtggcaaggaattccaattgcgaatatataaaggactacaaattattaagaaaaacacaatccagtaaagaagtgggcaaaacacatgaataggcatttcaccaacagagagacgcatatggccaataaacatacatataaagagatgttcgacatcattagtgatcaggaaaatgcaaagcaaaactacaatgaaataccactgttcacccattcagttgtcaaaaatttaaaagtctaacagtaccaagtgttggggaggatgtgaatccatatgatttattgaatattgctggtgggagtctaaattggtaccagttgtaaggaaaacgggtttccattatctcttacagttgaacatacatctaccctctgagccagcaattctgctcctagagggaacaactattcccagtttggtctgtaaccttccaggtctccctctgtgcatctgcaaaatattcaggactagagttgccttgtttgtccaggtacgaaaaccatagtatggatggccttgctccaatttatactccttccatattttctcagccttatctacttcccaggcgatcaggcacttgatcaatggaaatccctgactgccactgacgttttcacatctcctgacacttctgactccttcacttttctaaagtgagggctaggttctgaaatgacctctactgcactcactgcagcaggagcttctgcactcaagctcatcctgaccagatccatggaggctctgatgactcctaccacttttggattcaggattgaactgtggtgtgtgggatctggctttcctactgactaccaggaccaaggtaacacaactcagaggtgtgaggaaactaacaaacacctaatagggtgaactttgaccactgacagaaatgagacaaacacccgtaggcagatcaattcctttcctcaaccatttcaagatggtgtgattctatacaactcttctggaagcattcaggaagactgtgagataagctgtgttttcttgagtaacagtggcgaactcagtagcacaccaaagtatattttgtttccatccttccctacctcacttcatttattccctcactcttacacccatgggattgcatccttcactaaagatttaccacatatgttttgctccaggctttgctttctaccaaacataggctaagaaaacaggtgtcagaaatggggtggcctcagaaaacagaccctcaggataggacttttgctatacaaatacatggacattaaataatctgctcttgaatggtatttgggtcaacaatgaaatcaagatggaaatcaaaaatttctttgagctgaatgataatagtgacacaacttatcaaaacttctgggatacagcaaaagtggtgctaagaggaagattcatagcattaaatgcccatatcaaaaagtctaaaacagcacaaatagacaatctaaggtcacattacccgacttcaaactatactacaaggccgtagttaccaaaacagcgtggtactggtataaaaataggcatgtagaccaatggaacaaaatacagaacacagaaataaagccaaatacaaacaactgatctttgacataacaaacaaaaacataaaatggggaaaggacaccctgttcaacgaatggtgctgggaaaattggcacgccacatgtagataattgaaactggatcctcatccctcgccttgtacaaaaatcaactccagatggatctaagatttaaatctaacacctgaaaccataaaaattctaggagataacactggcaaagctattctagacattggcttaggcaaagagttcgtgaccaagaacccaaaagcaaatgcaacaaaaacaaaaataaataggtgggacctgattaaactgaaaagcctctgcacagcaaaagaaataatcagcagagtaaacagacaacccacagaatgagagaaaatatttgcaaaccatgcatctgatgacaaaggactaatatccagaatctacaaggaactcaaacaaatcagcaagaaaaaaataaccccatcaaaaagtgggcaaaggaatgaatagacaattctcaaaatatacaaatggccaataaacatacgaaaaactgttcaacatcactaattatcagggaaatgcaaattaaaaccacaatgagatgccaccttactcctgcaagaatggccataataaaaaaaaatcaaaaaagaataaatgttggtgtgaatgtggtgaaaagagaacactttgacactgctggtgggaatggaaactagtacaaccactgtggaaaacagtaccgagatttcttaaagaactacaagtagaactaccatttgatccagcaatcccactactgggtatctacccagaggaaaagaagtcattatttgaaaaagacacttgtacatacatgtttatagcagcacaatttgcaattgcaaagatatggaaccagtctaaatgcccatcaaccaacaaatggataaagaaaatatggtatatatacaccatggaacactactcagccataaaaaggaacaaaataatggcaactcacagatggagttggagaccactattctaagtgaaataactcaggaatggaaaaccaaatattgtatgttctcacttataagtgggagctaagctatgaggacaaaaggcataagaattatactatggactttggggactcgggggaaagggtgggagggggatgagggacaaaagactacacattgggtgcagtgtacactgctgaggtgatgggtgcaccaaaatctcagaaattaccactaaagaacttatccatgtaactaaaaaccacctctacccaaataattttgaaataaaaaataaaaatattttaaaaagaactctttaaaataaataatgaaaagcaccaacagacttatgaacaggcaatagaaaaaatgagaaatagaaaggaatacaaataaaagtacagaaaaaaaatatggcaagttattcaaccaaactggtaatttgaaatccagattgaaataatgcaaaaaaaaggcaatttctggcaccatggcagaccaggtacctggatgatctgttgctgaaaacaactgaaaatgctggttaaaatatattaacacattcttgaatacagtcatggccaaaggaagtcacatgactaagcccacagtcaaggagtgagaaagtattctctacctaccatgaggccagggcaagggtgtgcacttttttttttcttctgttcattgaatacagtcactgtgtattttacatactttcatttagtcttatgacaatcctatgaaacaagtacttttaaaaaaattgagataacagttgcataccgtgaaattcatccatttaaagtgagcaattcacaggtgcagctagctcagtcagcagagcataagactcttaaagtgaacaattcagtgctttttagtatattcacagagttgtgcaaccatcaccactatctaattggtcttagtctgtttgggctgccataacaaaataccacaaactggatagctcataaacaacaggcatttattgctcacagttctagaggctggaagtgcaagattaagatgccagcagattctgtgtctgctgagggcctgttcctcatagaaggtgccctcttgctgaattctcacatggtggaagggggaaaacaagcttgcattgcaaagaggtgggcctctttaatcccaaaggccccacctctaaaaggccccacttctgaataccattacattgagaattaagtttcaacataggaatttgggggaacacaaatatccagactgtagcataattccagaacggattcatcacccacggggaccccagccccatgagtagtcactccccattcctagtccctggcaaccactaatctactttctgtaggaccactaactgaatctaccacaagggactaataaaaaccctgccctgagaattcataagtataagttggcccttgctctggttggcagctcaaagttgcactacctgagtgacctgacaaaccttaagtagataatttaacttcaagggttttcttgactgatagagccccaaggtgcctggcagagcaaaatatgtctttttgaaggagtcctcattgataccagaccttaaattccatacatatttatagactgataaatcgctaaacaatcaaggaaacaaagtcccgtgagggagatccagcagaaacgataggtgaccaaattgaaccaaaaacttcagatactgaaattcaagattagttaacactagaaaatttattaatccaatttaccatattcatggagaaactcatattatctcagtaggtggaaaatattcaatgtaattcaatatccattaatgataaaatatcttttatcaaatctaggcatagaaagaaccatctttagtcaggcacggtggctcatgcctgtaatcccagcactttgggaggccgaggtgggtgtattgcccgaggtcaggagttcgagacagcctggccaacatagctaaaaaccatctctatgaaaaatacaaaaattagctgggcgaggtgacaagcacctgtagtctcagctattcgggaggctgaggcaagagaatcgcttgaatccaggatgcagaggttgaagtgagctgagatcatgccactgcacttcagccttcagcctgggtgacagtgagattctgtctcaaaacaaacaaacaaacaaaaaaaatcttccctctttaaccgattttaaaaaactatttgtaaaacatctaaaatacctacaacgaatatagttttaaaaagctgaatgtatttcctttaacatgttgaacaagacaaagatgcctccctctataaccacttttctctgtgtcgtattgtaagttctatccagcagaataaggcaaaagtaaattatcatggtataaagactgggaaggaagaaacaaaattgttgttatctatggatatattattgtctttgtagaatatttaaaaatctacagataaattattaaaattaataaatgctattactaaggttgttagctacagtcatacaaagaaatcaattgtatttctatacaccaaagatacacagaaaatttaattttaaaagacaccattttgttatgacatctaaaatgatcaaatacctaggaataagttgaaccatatataggtactgtatggagagaattataaaattctatctgcatacattgaagaagagctaaaaattgaaagagaaacatgttcatggtttggaaggcttaattttattaagatgtaggttctcctgaaattggcctatagattcaatgcaatcctggtaaaaatctcaacaggtatgttttgtgaaacttgacaatctaatttcaaaatatgtgtggagttgtaaagagcaggactagctaaagaagaacaaagtgggggacctgtcttgcagatagcaagaccttaataaagctatggtaattaagagtgtggtataggcacagaaatagaccaatggaccagaagggagaggctagaaacagatttgtgcatatttagacacttgataaggtgacatgagacatcaatcaatatatgtaagatgtacattggtttcatccagtaaggtgggacaactgaaatagaggaggaagcttccagatcgtgggtagataagagacaaatggttgaattcttttgagtttctgattagcctttcactggatacacaatttacaggaatagtcaatatgtcttggtctggctcagtgcaacagtagggcaaaagaagtaatcaggtatgcatttgtgtcatgtgagtagagggatgactttgagtcctgcctgccacttgtttcacaaggaatttccttgtgggcaaattgtgagggaggtatgtagcttacttatttatttatttatttatttatttatttatttatttattaatctttatagctatcttatttaggaatagaatgggagggagatttgcccaatgcagttccctgcttgacttttccctttggcttagtgattttggggagatttattttcctttcatattctccccttttctttttaaaatctttcggagaaagcactttagaagaaaatgagcctctggtctcaggttttgtctgatctgtcgtggctaggatgctttattcctagacagataggtcccacattattaggaaagctcatttttagcaggttgtgaagtctcatgtcctacaaagggaaaataggggtaggaagagagaaaaacaacaacaaacaaacaaaaactgaggaacaatcctggaaaatcaatataggccatattcctctgaagtccatacatcagtaggcaggcatgaaattggtttatgtgtaatatgtaaattggttgctgttgttttcttctgaagtttaagttgtctagctttagtttacagagctttaagaaagcacagcttaatttttaaatttcaaatcaggaaaaatgggaaaaaaggaaagaataaaaaattgaaaacgttattttggagacttgtagccagaaaaaattttagaattcagcccaaactgtagaaaataataaaaatggaaaaacgttagggaagaccagaatctaataacaggtgtaccatagtttattttgaaacataatttttctctctccagttccattttcagtaaagacaaatcataggacaaattcatttgcaaaataagttttagtcttattatacttggctggagtagtcacataaagtcagcaagaataattatttgccatataggctcctctttttttttaaaattggctttgctggaactttattccataaggaatctcagatttgaatttaatgtcttaagcccagcctatgtctgcaaatacctatgttaattgggtgaattccttacctcgaggttccaagaaaacttggggatcctgggccagtcagaaagtgacatttttcacttaccacaggtcaggaacctgtatagggactgcatagacaaggtatgaggcatgttttcccaaggggcttttattggctctataattcaactttgattacttgaaggaatctgtatttgaaagcatgttattccagtcaaaaccttggtagaataaccagtgtctccaattgtgtcctgttaccaaagaaagcagattcttactgtacttgggcaaataacaatattgccacaagttgagaatactcacaactactttccaaattttggagaaatcaggtagagagaaatgtgctccaaattttgtttataggaatatattttacttaattgtcaaaagtttcaaaaagtttctttggctctgaaaaacaaacaaaagatcagcaatgttttaggcaaaaagtcataaaaggatttatttcagtcttctattagtttagtccatgcagttaactcctgttctgcttgatattcatgaacatttcagctctctatgggagtcttggaagtttttcctctaatctagtgtcacaatctccaaggttatcagaaacctgcaatcaagagcacctgtcagagtcctatgctgattataaaccaccttttgaaaaggataaaaataaaacaactgtggatgacaaaagtcttaaaatagtcatagttaaacacacaattgacaagaaaatttggttatttctgtggcatacaacagttttacataataatcataatcactactgataacatatgctaagacctatcagaatcacaggaatttcatacaattctggaacatacactaataacacagttatataaacataatccaaagaagcttaaacactgtttcatatttgacaatacttcctgtatgactttattataccaaataagctgaatatgtctcttctgaacttcagggaactaatataaaaaaattaatgaggactgaagttaacatttgattttggaaagtttgtcaaatataaaaagtttaaaacacttgatatcacaaaataggatcacaggtcattgtaaaataagtcattcatttagccaaagtgataactcagttttttttttaaaggtgaaaatctttagtctttgagagaggagacttaattttccaaacaataagccctaataaagacagcatgaggccaattaaatttttttttcaaaattttataaacaatctataaaatgttaaccatcctgaccataagatataatttccatagcctttttataacctttataatcttttattaaggagtagtttaacgctccaagaaaaccttgttaatctgacatagggacccctatgctagtcctacatcagtgtgccttcaacattaatggttaatttatagagaaactgaacttactttatctctcaaaatcagcccttacaatctcatgtgcttgcctcttccacgatagtccctgggccttgagaagttaaatagttttaatttctggccatgtgtctcatgaacaaagtttattttcattggcatcttctatggggtttgaagataaggatttaactgccgtcagtgtttaatatttagcaggacttggggttcttttcagacccagtagtcaaagccctgtgactcactggcacaagaactttaaaagcacatatagaaagtcacacggatgtaataaccttaattttaaaaaaagttttaatctcagttttttccctaaacaaatcaaaacttagtaataatgacatagaaattattttgataaagcataaaatctgtttattaggccagttacccaaaggcaaaagagaccttctgcagtgcgactgctgttccctatggggagttccatttagataagttcgagtcaaaactaatgaaaaaggtacttgaactagttagacataggaagaatgtttcctggatcataaatgcaaattttcagatccatagaacaatttaaagccaagagcacagaatattatgttggaaggaaacactttctttagacctttaagataaaacatttttagcatcagatcacaacaaacagaaaccgaaggaggaaaaaaaaaaccgtacaggagctgaaaatgagttgaaggagagttattatttcagacttttaacggagagaaagctgaaaacacgagacacaaagttgaactttgcattaaaaatcataatgtcttatagttttattaagggtaaagcaaataccttaagaaaatatcattgttctaatcaatcctttagtgtataagtgtttttttctttaaatatcaaaacccaatctctagaaaaaccattataaatgatttccctttaattatagacaacttgatcatgtaagtttttttattttcataattgagattttattggttgaggatcagtacagacatttcaatttgtacacaaatcttaacatacataacgaaattctaaaaagccatgtattgtaattcttttttaaagttattccagtgactttccagcttaaaatttggaagcaaattttccttaagaggctatcaagtaccagtatcttcacatgttggtcagctgttacatacggcccaccagttcacaactgaatagcacgtacactacatgttcaaatttgtaatctttcacagcacagtaaccaagtgattaggaaaaccacaaccaaagatgttacagagtgcacacaattctgacagggagagccatgatcaaagagtggttttctttaggaaacaattctactaaaaaacaacatgggaatagaagtaatttaaaatgttcaagacattaaatgcaggactgactccatattgccatttaatatgctttgtattataggatataaaaactaacccccccatctatggaatgttaagctgacacccgagacagtcagagcctcccataattcaatatcccacactattttctggttgtaccaaaaaataaacaaccagcaaatgatttcacctcttaaaaaaagcatttacacttaaaaagtgggatgaggtgggattccctccttcttaaaaatgtttctagagctactaaaaaacttgcatttacaaaatagttgataaaaatattcctctggattgtacaagaagggagacagggaccactgataagacatggtatatggtattaatcagacttggcttctttctctcctgcttcatcagaggctggactctcctcagttttcgtttccctgtttactgcaggtaaatcttctttagtttcttggttagccacttcggcctgttttccctttgctctccttttcccttttgtttgcacttttttgtctgaagatttatccttcgctgctgccttttttggcttcacttccacttttgcaggaggtttagctgacaaccgcgccgatctcctcttgggctcttccttggcggcccctttggtggagctgaccttcctcttgggcatcctggtggcagggagggtgtgtgccgggtgcctgcgggctgcggcgcgccgagagccttcgcgaaactgggctgcctggccgctgccactcctcccgccacccgagctgctgagacccaccgatcatataagatttgatcccatattttttttttcttaaaaggaggaactgagctgtggccagaccattcatgatatgcttggactttctggtttgtcctgaccttccctctttcttaaataaacaatcattttattctgggacaaaaaattaccatataagattctttatcatataaaattatttttaagctttcttaccaaaaatacttcatttctatacctttctttacatatctcttatttcccggttctttttaccttgttttatacataacctttaaataacctttgaattagacaaaaattactcaccctttaacaagaacacacacattttttagaaaaaatgttttcctacaatacatattttttcattagaaaacacccatttaatgaaatacctattatttaactttagattctaaatgatggcaagtttatctacaagtatttatcccatcacatttacctaattattttattttaatagtttacctagattatttatgaaaactgcaacagtcaccaaagttattttcctgtcaaccattttatagcttgtgaatttcaggcatttatctgagttagaatcttaagattgaatacatggttattttaccaaataattcaggatttagctgtcttcattaaaccaataataatgtcttttttgtgaaagattacacaagcaaagatcattctgttttgggctgggtttattgtttaataacctttatgacagctgggcacggtggctcaggcctgtaatcccaccattttgggaggccgagatgggcggatcacgaggtcaggagatcgagaccatcctggctaacacggtgaaaccccgtctctactaaaagtacaaaaaaatcagctgggcatctgtagtcccagctacttgggaggctgaggcagtagaatggcgtgaaccccggaggcggaacttgcagtgagcccagatcgcaccactgcactccagcctgggcgacagaggcagactccgctcaaaaaataaaataaaataagctttatgacaaattttgacaccttataatatttggcagggataagtatgaaatctcttgatcaataaatgcaaacaaaaatgtatactgacatttctgaagatatttgtaatattactctaccaataattttaaagctagcttagtaaaaactctacttaagtcatgtgagcttgaaaagcatttgggcttattatttaatttatgagtactctttaagccaaatttggtaccttgtggcagaaaacatataaccaaatacatctacatacacgtaaacacacacacatacacactcatataaacaaatatcctagagcatttacttcagaactctagccatgcgatattaataacaactcattggtttgcaaaaacaataacaaaaagaaacggttaggtgcaaacagtggattttatctcagtagaaaagtaacaacagacttaaagcaggcagaaaagaaagcagagagatagagaactcaggagctttatagttgcagattgaccttcaggctcggaattttccttgatgtaatctgcctgtcagtttaaaacgtgcacaataacagacctaacgcgtgagcagctggagtcgtaggaaatccggcccttccatttacacagccacttgcgagtacaggagccatgaaaccaaatgggcttccaagggggcttgttctccttgtctttccttattcttagatgatgtgtttcccacattgtttttttcttaaaaggaggaactgagctgtggcctagggtttagtgtggtgggtcaaagtgtgctggttgcggacaggactccacaatgcatcaccactgaattgtttcggccctcttttgtgtctcagtttctctctccagaggtctagcacctctgggagggctcaaagcttggggtgagcagctcctatatgtgctccctggacgaggcttttaaaactaattttgttggcaattccctgtagggctactgcacatcacatggaggcaacccccagacactcccacttggcctccagtcacccaggagcaccttttgactgggaggagcaaaatgccctttctctttggggttgaggaaactcagtctctcatttatctatgaaagtgacagtgcagttcctcatgcaaatatgcagacaagccaatggagattaatttgggcaggaaaggcaatggagaagactctttaaaatgcacctctgaattagaattgagatcctaaacaacctcctaggaggaaaaaagcccagccaagaccactttctgtaaactgtcctcggccacctttaactgtagctcttgtctgctattacacatgccaaggtcaaatcctctcacaggacaaggtaatctctggtacccctgatacaggacttaagaagaaatcacttaggcagacagtaagggtatggggatcctcagtaaagtttttctttttaatgaaaagcagcctcaaatgattttctaacaaagagcagcctgtaaagttcagctgcagacatagagaggcaagatggctccaatcaactggaaagtccatttgcataataatattcagctggggccaccagccttcccccgcactatgtaaacgtcatacctgatcgaaccaatctgtcagccctatgtaaatcagacaccacctcctcaaacctgactaaaatttggcgcatccaccacccgctggtcctttccaccgggagacccctttctctatagagaaagctgcttctctttctcttctcttctgctcattaaacctctgctcctagacttgtgtgtgtccatgtcctaaattttcctggtgcatgacaacgaaccccagggtgtataccccagacaatgtagccacttcacccccagaagccaaagaggtcaggtaatgcaatacaggagagcagagctttacacctaagaagaatctgcccatgactcttgaaactccacaaagaaaacagaacagccccaaaggagtgaacggtgcctttgtcctgagttctttaaagggttagagtcattagatgccttctttatattcttcttggtaccaaagatggcgaggggagaaggaggaatagggtggaagaaaagtaaacgaaagaacagttatttttttaagacagggagcaaacacacaaaccaactgcatgtttggtcatttttttctcttttgcagctgcgaggaattttagccaattcagagataccttgttactcactatttggaattctcattcaaatttgaccaagtcaggtagaattggccaaatctgatgggagaaagactggaacaaacaacaaaagaaccccaacaatatgattactgagtcctctaatggtaaggagaaattaagaccagccgactgtgaatcataactttagccaagagaaaactccaattcagctacttacctaggagtgggtctcaggctgaagactgctctctaccatcccagaagtaggaaaaaactcaaactcaccttccctgttggaagtgagctcaaattccagaatgcagttatttgcctttcattgtcatggaagcaggaaaacttgccttccttgttggaagcaagcaaaactccagaaaaggagttgtacagcaaaataaactttagatctcaaccaaattttgggagatgagggattctctggagggaggggagctcccaggcctcagcaaattgttctattggtttgagccataaagatagctcgagttggtaccaagtactgataggagatttgtcaaaggtcagggccacctccactcagagtctctttgtggtcaccaaatgtgtacctcaaatatctcagacaggtctcagtgaatttagaaagtttattttgccaaggttaaggacatgcccatgacacagccttaggaggtcctgatgccatgtgcccaaggcttggttttatacattttagggagacatgagacatcaatcaatatatgtaagatatgcaatggtttggtccagaaaggtgggacaacttgaagtggggagggggcttccaggtcatagttagataagagaaaaatggttgcattcttttgagttgctgattagcctttcactgaatacacaatttacatgtgagagcaggaagagtcacttatgctttagtctgactttgtgaaacaatagggcaaaggaagcaatcagatatgcatttgtctcatgtgagcagagggatgactttgagttctgcctgtcctttgtttacaaggaatttcttcatgggcaaattgtgaggaaggtatgtagctttaaaaaaaaatctttgtagttatcttatttaggaatagaataggaggcaggtttgcccaatgcacttcccagcttgacttttccctttcgcttggtcatttgggggcgatttattttcctttcatggggtcaatccatcaagaagacataacaactgtaaatatatatatgtatgtacccaacattggagcagctaaatatataaagcaaatatttacagaagacaagggagaaattgacagcaacacggggacttcaacaccccattctcaacagtggacgcatcatccagaaagacagtcaaaaaggaaacattggacttaagcaaaactccaagtcttttctgagttcaccttggcttgccacagcaggccacatgacaggccatgtggcagcccactggatctcacctcagcatcaattagaatttcacttcagtttttctttctctttgcattttctctgtagtaaattcctaacctcctgcagttttctctagctcaataaatgacaaccccattctttcatctgcttgggccaaaaacctcggaggcatgcttgaagcctcactctctctctcatctcatccaaatcctaatcaaatcccatctgctctcccttcacatccctcctccgatctaaaccttctgttggcccccactatggcccccaggaagagcctaaatcctttcaatggctcacaatatctactctgcccctcgcttaatctggtttctctgaatcttcacattagcatggtggctccacaagagctggggttagatagcaccattgcactccagcctgggtgacagagcaagaccccgtctgtttgttacctgttcagtgtctggctcacagtaggtgatcaacaagtgtctgttgaatgaatgatttcaaactcagaacagcaaaaaggaaaagcaaattaatatatatttttttgtgacggggtcttgctctatcacccaggctggagtgcaatggcactatctcagctcactgcagcctccacctcccggattctagcaagtctcccacctcagcctcctgggtagctgggatcacaggggctcaccaccatggccagctaatttttgcatttttagtagagatggggtttcaccatgttggccaggctggtctcgaactcctgacctcaggtgatccacccgcctcggcctcccaaaatgttgggattacaggcatgagccaccgcacccagccaataatttttaataatattacctgtattacatttataatagtcaataaatagaaataccttaaataattattatatggagaggtcattaaatgacttatgtcatctccactacattaaaaaaaaaagctcatgtttaaattagtttgggaaatgctatatattatactcccttgtggagattagtattagcctgttaaaagttcttagaagtccttgagcaaagaaagatagctttaaatttgtttaatccagcatttcccaaacataactgaccacagggccctcactgttttgtgacttttattaaaacagaactattgtttcacagaacagactttggaaaacttgtaatacatatatagaaaaaaattgaagggaggtacatcaagatgttaatgatgtttatttctggttgctagaattatggaaacttactcttttctctgtatttctcaaattttttttgcaataaatatgtattactattataaccaaaacagtaataaggatattcacattttaaaattgcaacttttgaaggagaaaatgaaggcaaaggatgattcaagttggaagacgatttaatttcaactgatagatacttcctcattttaagcagatagcaaatgccccactcttttggagtccaactggagagaccacacttgccctgttgaatcttctagttcttcagtggactggatcaactacaagaatgctgggaaaggaagataaaatggtgaatgctctgcacagagttgctatataattatataaccttttcaaagattggatttgacaccagtttttctcttaatatgaaccaaataattccatacaaacaaaatactttgatgaaaaagcagaataagaatgtgtttccagtacagtggggcttggaggtagtggtataagtatggttaggtagtttttcttcttttgtttttaaagtatctttttaaaaatgaactgatcaaacaatacagctcattgtagaaagatcagaaagtgggccgggcgcggtggctcacacctgtaattccagcactttgggaggccgaggcaggcagatcacgaggtcaggagatcgagaccattctggctaacagggtgaaaccccgtctctactaaaaatacaaaaaattagcctggcgtggtggcgggcgcctgtagtcccagctactcgggaggctgaggcaggagaatggcgtgaacccggaggcggagcttgcagtgagccgagatcacgccactgcactccagcctgggcgacagagcgagactccgtctcaaaaaaaaaaaaaaaaaaaaagaaaaagaaaaaaaagaaagatcagaaagtgcaattagacaggaaaaacaaaagttaacaccaccgccaatagtaataaaacaacctattcactaccacaaggagataaccaatgtctaatacttgggttaggttcttagaggctttccccctatacaattagtttttaataagaaattagactaaactatatatcttctgttataatctgctttttccactcaatgatatttcatgaatatgtttctgtgtaattatccttagtactcagtgtatgaatgtgcaatactttctttagctagccccagactgatggacatttaagtttccatttcttcactatcgtaaaccatactaaaaattccttgtacacatatctttgtggacttgttagagcctgtcagtcctcctgatttccacctctgcttctggaatgctgggagattagccaagcttccatgtgcctcaggtaataagcagctagcttaagccttcattacagctgcagctaatggtatacacaggtgagtatagaggaggaagaatgaggcacagagaggctgtgtgcaatcctcactgtgaaatgtcttaattaaaaatcaacaagtattactgagagtctactatgtgcccagtagcaagtcccaatttttcctgggacttgatgtgtcctttatgaccacagactccagtcttctttaatttctgcaacacttaaaaaattataacttggctgggcgcggtgactcacgcctgtaatcccagcactttgggaggccgaggcgggtggatcacgagatcaggagttcaagaccagcctgaccaacatggtgaaaccccgtctctacaaaaaatacaaaaatcagctggctgggcgtggtgacgcgtgcctgtaatcccagctactcaggaggctgaggcaggagaatcgattcaacccgggaagcagaggttgcagtgagccgagatggtgccactgcactccagcctgggtgacagactgagacttcacctcaaaaaaaaaaaaaaaaagtcaggaaacaacaggtgctggagaggatgtggagaaataggaacacttttacactgttggtgggactgtaaactagttcaaccattgtggaaatcggtgtggcgattcctcagggatctagaactagaaataccatttgacccagccatcccattactgggtatatacccaaatgattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcatagctgggaattgaacaatgagaacacatggacacaggaaggggaacatcacactctggggactgttgtggggtggagggaggggggagggatagcattaggagatatacctaatgctaaatgaccagttaatgggtgcagcacaccaacatggcacatgtatacatatgtaacaaacctgcacgttgtgcacatgtaccctaaaacttaaagtatagtaacaataaaaaaaaaagaaaaaagaaaaagaaaaaattataactttttcttctgttggattattttggttctcttcatcgaagaaatcattctgtgcctcctgcatctaccatttcttctctaatcttactttcaccaaactgtttacttaatactgcttgcctatataatcctattttccatattttctttcatattttgcaccaatgtctctttttcttcatgcttcctcattttggtgatagttttactttttgtcttttacatttttcttgggattttccaactaattttcatcttcttcttttgttttggtataccttatctgccctgttgtatttctgcatatagcatttactattattattattgagatgaggtcttgctatgttcctaggctggtctcaaactcctggccttaagcaatcctcctgcctcagcctctgaaaatgctgggattacaggcatgtgccaccatgcccgaccttagctattattttatattttgtatcaaatgttttgaatttatggcaatatgttagtacatggtttttatctgccctgagatatttttctagtgagtattcctcatctgccatttcttgcttatacgtttcttgtgttttccatatagtaactctgcatagatctggtgctgtttcctgttgaatgaggtaaactcttactggaccagttatttacaggagatgtgcacaagtccagagctatactttggactaacaaattctcttcatgatgctgaggtatgtgtgagctcttgtagcctttacttctttccagtcaagtgagagcagcagatgtaggtctgagcataaagaagtttcagactttaccttcttgcctcaacaaactgcttcttaaaaatatggcttgcctatatgcttattcattccaatttacctgttaggcttctacttggtgcccaactgggtccagaaatgtttctttcactagttagcttgcttgttcccagcaagggcttattggcttttctattcaggttaagccatctacttcaaagaaggaattctttttcttggcatattgcctgctttatcttcacagaagtccctctgaatattaattaaccaatacttcagatgcttttgatgcagctgacctgctgaccacagtttgagtaacaatgacttcaaagatgtggaaccagacatatcttgatttgagttccagctcccttggttggttgctaggtatactagtcagggatattcagctgctataacaaacaatcctgagatcttagtagcttaacacaataaaattgatccttcactcatgcctcattctgatgtaagttaagttctcctccacaaggtgattcagggatcccagctccttccatcatgtggtttcaccatcttagagtccttcagttgaagccctgcatatgtgaaagagagaggcagcatggacacatgtgcaagacattttatggctaggcctggaaatgtcatacattccttttgctcgtatttaactggccaaatctcagtactgtggtcccagcctaactggaaggaaggttaagaatataatgttactctgtgcttggggaagaaggaacaggattgctgaacatatagccagtctctgttacagtctgtctttctgatcacccagtatctgtttcacttttcctttcatacgtggaacacagccaccctgtcatgcatatggaaatattccacccatatttccgcttgagaaaggccttatttccctagctgctgagagtgttgtcagcagaaagcctctacctgtcagctcattcagagtctgcctcagctgcagagagcttccatgtactttctgggggcagcccacatccagtgaatgactgaggtggggttagagaggtccagccatttcagccatgtgggacaaccctgatggggccgactgagtctttgttgggcttgcaaggcagtttgatttctcccttccaccccctatcttccacaggcattgatcattaattatactctgaatgccaaattccggtctccctgtctagtttcagaatacctgacttgtggcaaaccctttcctcagtactaagtcacactcatcactgtgtccagctcaaagtccagagtatctgggtgatgcttagttctctcaagtctgagggtggctctgcttggttaagtgacctatgaactaaaacgagttatatgctcctgatctccacaccccagaataatgatggaacaggaagaggataagcaccataaacattcccatttggaaataggaagaatgagagacacacagcagtcactgctctgtggcaatcctggagtcctggtaggtaggcatggattaggcccaaatcctgctttcaaagggtgactctgtggcccattgtccattctctgggaggctctactgatccattattctctatggctgcatctgaagcaaatgttgggaccttcgaagctggtgtccttctttttcatggaaaggtggaggcctaactattgtttacaacagatggctcatttagttctggcttatggtttctctggcaataagcttctctcaaaagcttagctgacttctaatctatttgtctccaatcagttccatgtgccagtaaccacatccaaggttgcttcctagacacagttcttgatcctgtgatcattttgaggttacaggagccataggtgatgccacacccttaatctgatctttatcctcagccacttttattagatttttgagctctgcaggaccccccatttctattctctattcccttttagttcctcttgcaaactggccaactatttcctgacctcatctctttaacacctttgttgatcactttcataggtctccccacttggactctgtctcccacaatagcaatgacctaccaatttgtaatttttaattgtcttctttctctgcctttctagcaacaagcacagagacaagcaagtagtcatttgttggtaaatactgactgaattaacaaaatttagctcaactattttgttttcctcaggattcttttggcttcatatgatttatgtagataaatattatgataaattttcaggaaattgagagcacagctaattatttattttctatgtatagttcttgagccacagggaagaaaaattaggagttaataaagttgataaaagaaatgaccattggaaacactagtcattaaatgtgacctgtcagtcactggtaacaaatggagcaagttggaggaagtaaaagagaaagtagacattttaaaagggggttgcatgacctttcacagttttcctcccagaattgaatttcttaaaactttcccttaattacagatatgcaggctggtgagcaacctgtttctgttcccaccccccttcacattccctctctcctccctgtctcttcttcccacagaagcttacgtgaagcagcagaggatccccattagtgctgaggtgagaagaaaagcaacaatggctgctggaggtaaggcactcttgataagttgccataagtaatccctgaagttgttcagccaggacctgtgattacctgcagaaagagcatagacattcattgaggagaggtcaagtaaatgatagggctggcgtttgaatccaaattcgagttcaaatagttgtcccagatatcatgttcttacagttgtccagagcccatattctaaactactttgctgtgctggctgtaagatgttcaaagggcaaacattttgtttttaaagtatcctgagatggatataatttttgcctccttgtaagtcaaataggaacaataattgttgtttcggatatcttgagtatattgggtactttttgaaagagaagcatgacttgataacaagaaagtctttactaaggtgttgttgcctagagtatatctgggagtcctgcaggaggctgaggagagggagtatcccaggaagagaaaggagaaggccaccagccctaagagcagaggagaaaggggccagggccactggaagaaggacctctagggggagtttgctgatcaatgtaaggctggggatgttgggtcttttcattagcaactgggggaggaaggtacagtgctttgaccctgaagaaagaaggaggggaaaacgaaagtgtctgcagcatggagttgagaggattcaccactaaccagcaagacacttgaatagcatgtgtgtgcatgttggaacctagattgtggatcagtggaccatcaggtttattttcaatttcacctcctttgtcaagtctttcctgacccctcccccaaaacaatttaaattatccccttgtcccctgggagcattgatcatactccatggaaggttggcatctatggctttgtctgcctatctgtgagctccttcataacagaggctgttcaattcctaatccatgtagttcagaaaagggcttggtacgtagtaggtaggttaatgcttgttgaactaaattgaaccaaaccagaatagtttgctttcctatgaacattctttttaaacatgaaattcattttacctgacctgaactgaaacatgaatcttaagtcctatgaagaaagaaacattcatcctaacagcaaacacaccccctgagcgtggtttcgatcctgttttttcttgtattcccaaggcagacaaaggcaaaggagaggaagctactgtctccaacaagaggcaagttagagagcatagcagaaatccaattatcagcagcttctggggttccatggactcccgccttcagctgcggctgaagagctggtaatcctagctcactctgccaaggagagatgtctttgtccgtaggtctttccacagaaactttgtctgaaaagttagacaatgatggtttagctcatattccaaaaatcttctcaccatcacgaacataaggacaattgactgacttacacaggtgactcctgaaaatggtcagtttccaaagcaaaatatatcccctccaagaaaacaaaacaaaacctgactatgctctatcaggtcagataccggacattccttcctacacctgataccttttcaatcttccccaactcaattagtagaaactctttcacctgttcaggctgaaaaaggtacattcacattgttgtgcaacagatctctagaactttttcaacttggaaaactgaaactctaaacagctcctcatttttgtttctatgaatttgactactttagataccaaatataataaatttctatatatttttaactccatgatatattttatatattcaagtaacaaactttaaattgctttaaaaagtaaatgtttgcttagatttacatatatagtaatgactcttctttttctctcatacactttatccatcagaaaagtctagtcacctttacttacaaaacgtatccagaatcctgccacttcacaccacctccactgctacccaccatcatctctgtctttctgcttccgtccttgcctcccttaagcctcttctccagtgagtggccaaagagatcttggtaggttgtaggtcagattatgtcctagttactgctgaccacatatcctatgagtctcctcttgatcatcactccaacttagcctcatttcattttgaacaagctaggcatgttcctaccttggggctttttaacttgcttttccctttccagggaatgcttttcccccaggtattctcagaatttatttcctcacctctgtcaggtactcaaatatcaccttctcaatgaggattttccttagatcccattgttaaaattgtaccaccctcctacaaacttcctaattgtcttacctgcttgatttttctccagaacctcatcagaacctagtagaatatattttactttactttattatatgtatctcctgaatataatgtaagctctatgagtgcagggatttttgtctgttttgttcactgctaaacagtacctagcacatagggtatccaggtgctcaataaatattttttgaatgaatggcgacttttggcagatattgttcccacccatttttcatttactacatccaactagataagctgaaaaagctgaatcctccctttcttagccatccttgaagttaggcatggctatgtgacatagctctggataatgaaacataagggaaatctgatggatagcttttgggaaggctttttgctgtcttgataaaagagatggtgctaccattttccctttatgctgccttgaatattgcttaagaaatgttgcctgaagttgctctgataatttcaagccactaaactaacacctgtatctgcttacttctggactgcatggtatgagaaaaatatacttttatttgagccattataatttgggcctcctattacttaagacatttataactgatacactcacctactgtttgatacggcttaaagagacccacatccagcgggaaaccacttacctgaaaatggacttaggaccacggaattcaaagaaaccagtggaattaggccttagtctttagagggcagaagtcttcagaagaagctggtcagtcttctccttaggtctctgaagttccaaacagaattccaccactccttatgatatcactgattacatttaaccctcccccagtctccttatttgacagctaagcacacagacatcattttctctctatgtataaacatctgtgttgataccaaaacccatccttgcagtagttctatcctcttaggcttgaataattctaagatattttattcaccacatggtatctaactatgcattataataacatatatatgtggcatttcatatcagggaaaaagaccttatttaatatgatgttgggtgtgagccctttgccatgctatgcaaaatagaaattctagatggatccaggactaaacaaaaaataaaattatatacaaaatatgacattttctgtcatacttttatgatagaaaattctatgtgtggatatttttataatcttggtgcagaaaaagctactctaagcatgtcataaaacccaaagccataaatgaaaatgctgataaatttataacataaaaatgtaaagctttcatatagcaaaacattgtttaaaaaagataaaaggttaatgacaaattaagtaatttcacagcatatacgacagacattcaattaagattgttaacgtacaaagaactcttacaaactaattaaaaagaaatagtactggctaggcacagtggcagacgcctgtcatcccagcactttgggaggctgagacaggaggatagcttgagcccaggagttcgagaccagcctgagcaacatagcgagatcctgtctctacaaaaaatttaaaaattagctgggtgtggtggtgcatgcctgtagtcccagctactcgggaggctgaggcagtagcctggcttgagcctgggagattgaggctgcagtgagctatgatcatgccactgcactccagcctgggggacatgaggggcttaaaacctagatgatgggttgatgggtgcacccaaccaccgtggcacatgtatacctacgtaacaaacatgcatgttctgcacatgtatcccagaacttaaagtaaaaaaaaaaaatgcaaatcaagtcgaggcaacatagcaggatactgtctctacaaaaaataaaatattaaaaaaattaaaaaaataatacttatccatagaagaactggcaaaaatggtatctcagttaggttctatcagaaaacagagctaccaggaaatacataaaatgaaagtttttgtagagtcctccagtctcccccagtttcttgctgtgtcatgctagaaaatcatggagtggcttgatcattctgtgacccagccaacaggcctgaatgaaaattaggaccttgaacattcccaggcgctgataaaggtgtatctaggttgtgacccgaaacactggaggaagctggccctggcccttgagccaaattcctctaaaccctcatatgagctccataccctgacctttctgtggaaggaaaggtgaggtgaagtggagaaagcaagtatacactggaagcctgaaaagagaagagcccatgaaatggactaaaacctgcatcagtctcatgttatctccaagcttctaacttcgatggtggagtaacatgcatgagaaggtcaggtgttttctgaaagagctaaacacacaacttttctaggatttggagaagctaaaagatccagcaggagctggaggacctgcaaacttggtcactgtcctgtgcccaccaggtaaccccacaaaatagtgacaatgtgaataagctgaaaatgagcattgtatgcctgtctgacttttccattgtaaaaagaatatggctgtcatataagttaactttagctgaatgaaaaatgacctccaacttagcaactgtgaagaaaacatttattaccttatagtttctgtaggttagttttggagtggatgatgagattggagtcatgtatctgctgggactgcagtcatctgaaagcttgactgtactggaggatctacttccaagatggtgcactcacatgactattgctaggatgaccaaaagtcccagcttgcctgggactcaggattggcttcatgggagtttgatctatgcaggtctacagggccccacaccctgaggggccctatgtttcgtttgctctgatgtcactgtctcgaaattcttaataattttatctttgatcttgtgttttgtaagggaagtttaatgagaccgcctatttcatcacactcattttctcctccccactgactttgccaacattcttctccctttgagtctcactgaactctgatgcattgtgggtccactagaatgttatgctcatgggcactgtatacattctttgctattctatttgcacatagtgtttacaatgcatttttgcattgttgtaaaactgtagtaagaacacaacgtggtatctgctctcttaacaaatttttaagtgcccagtatggtatcgttagctatatgcacaatgttgtacattagatctgtagaacttaattcatcttgcataactgaaacttttttttttttgagatggagtctcactctgttgcccaggctgatggaatgcaacggcacgatcttggctcactgcaacctccacccgcctcccgggttcaagcgattcttgtgcctcaacctcccaagtagctgggactacaggcatgtgccaccatgcccaactaatttttatatttttattagcgacgggatttcgccatgttggctaggctggtcttgaactcccgacctcaggtgatccgcccgccttggcctcccaaagtgccaggattacaggcatgagccactgtgcccagcagcatagctgaaactttatgcccattgaacagaaactcccatttctctctcagtctctctctctccatataagctgttctcctggattgaggctccatttctgatttattttattcagactctcatgaattatatcatttttactctgagttcaatttaatctggttttctaactcactaatttggttttctagagtgtccatcttgctattcagtgcccctatttgttttaaaaatcagtgttcacatttttatttccagtgtaaaaacacaattctcaaaggcatttgtttgtatgtgtcaatgttttatttaactcattactgaagaaaccagcaggaaaataaaagagctagttccatgaacatttgagaaatagagatgtatatagtcaatgggaaaagaatgccaaaataagattatcaagttaaacataacaggaaataaaaccatatcacctttggggttaactcctctaccgggctataaaacaaaacaacttattcatttctgtaagttagcctctaaactttaagaacttcacagggctataaaccatttgcacctgcatcatttgtggattgtgactatactgtgacagctatgttatagtttccaaagaggtcagataagggtcaagcaggattattagaaaatactccagcatagaaaaaagtagccattcttttgccttttctcagattgggatccatttttctttcatattaggatctcctgttttccatttgccctgggttgcaatctttggatgcttcctccaactgctctataacttatccttgtctccagccccctttactatcaggagattctgtgtagtcatagtgaaggggtcaggcagatggaaggagcagtaaacccttcacaatcttatgggggtggagggcaagaagggggatcctattgtgtggtgatatggcagactggagtgttttttctgttttcaccagtccaattttcttctgacctccttgatatttcaactatgtaagtaggactctagttttcagtcacggtatataatttcccctgttacatttttgttgtgttattttcagcaggaaattagtagagggagagagtaaactgagtgcattattagaattacaaagtttgtatctcctatctcagataaccatggattttcctcatatttccacagaaatattaaatgtatgtcctttagaagcctaatgtcatcatcattttctttcttggccatcacaaatttcaagaagacattgttattttatttcaaagctttcaacaattgcatcctcctgacttatttttttattggtcagaattaagaccaaatggctttatatctatggacactcgtcagaaaaatgcacatttgcatttatacagaatgccttatataatttcaggggacttagggattcttgaaccccatctataattctcagtttaagaatgctagttttggagataagaatgtgcccctcataatgactaaataacataattatatctatgtgtaaggaagcagaaacagactttactgtagtagttattgtattctctccattttgcagattgtccaaatgatttgccttttgactccaagattgtattgatctgatcctgaaacatgctttgttccatgcttgatcaggataataaacaactgagagttttattttaaacgtatgaggcttaacctgaaatgttaacatcataaatatctttttcaaagtttcatcacatagtttttctacaacagaggaagtggtgactctgagaggcctaacttttcagggaagaatgctttcatgcaggtttctcctcacttctttttgcctagttatattggaaggaaggagtaatctgggagcagctgcagaaaataggtaagagttaagttaaattggatgcaccctcctggccccccaccaaagaaatgcaggactgatgatagttaattcaggaggcttcaaggcagtgtctgctaggatttagcacaaaggtagaaggcaagccagggagggacactgccctggagctgaggagggagaggtgacggcagtggcaggtgctgcagtggccaccctcagtagaggtcctgtgcctcgcagcccagaacctccatcctcagggcaatctggtgcacccaactctgggggtgaattcgaaggtagcgagtcagtaacggtgggtctagagagttcaccacaggtgtgaaggagtcttgatttccctgaaaaacctgaaagaggaaagatagcatttattggttgtctgacaggacaatggtcactgcaaagcacagacgcttttctcacttctagttgtttccagtagtccaggattaaaccctggaagatgactagatgactctgtcctacgcatctgggacatctagaattaagagcaccctgctttggaggccttcactctagctaggccttatatctacagtgttctcacccacttcccaaacctcagtgacattaagtgctttgtcctgggtcacacacagcatctgtgttggaccatctggagatgagagtcaggctttggccagcagactcccttgtcaatgcatttgctgtggcaagaggagtacatggcaagagctcagaaaatggtagctatcgttattagataaactggtttcgcacatgttggtgacaactttagaatgataacgaatgcaacacagcaaggcatgcaatttagtgtggctgggcaaccttggcaggaggggatgcagaagagagaaagaagtgggaagagtctaagactcaaggcaccttgctactccaggactttggagcaaaggtcacctataactgggtggatgtttgggaaaatgaagatctgaatgttcaaaacgtgtaattcaaggcaactctgaaaccctgtgggttttgtgtggattccgaggtaatcctacagtagaaagtccagccaaatggtgagaataagcaagagtcttggagaaaaaggaacagaatgaaggcaatgtcctaccataatgcatgctcttgcaaggacagacagacaccatgatatctttaggatctcctgaggcagtttgtgtaaaaggaggcaacttgccaccaaaatgggaaagaagtggttaaacagcaacagtagggctcctgcttcctggagctattgggtgacattttcctctaacaatcctggcatcttcaagtgtggtgtcagttttacttcggattccaaatgggaagagacttttcctggcaaatgcactgtgaagtaacactgtgatcctacagagagtttagctatcagaacaaaagacgtttgggccatcttcattcatctagctacattttccccctaggttcccaaccctggctgcttattggaatcgcctttggagcttttaaaaaatgatgcatgggtaagttccccacccccccacccccccaagagatgccaatttaatcggtctgttcccaccttggcccccttactctggtctccaagttctgcctaatatagcccctgcccaagtctctgatctgttctcccactgcattcctcctattttaccgcatcgcagatgagctgatctttcagtttctcaacaatgtcaactcttgttttatttaacatgagagcctttgtatatgtgattccctctgcttggaaggctcttaccccttctgtttcttcttttatccatgttttttacccttcgggtctcagtttaaataccacctcttaaactaagcatagtggcatgcccctggagtcccagctactcagcaggctgaggcaggaggattgcttgagcccaggagtttgagacaagcctaggcaacatagcgaaattctgcctcaatttttttttttttttttgagacggagtctcgctctgtcgcccaggctggagtgcagtggcaccatctcggctcactgcaagctccgcctcccgggttcacgccattctcctgcctcagcctcccaagtagctgggactacaggtgcccgccaccatgcccggctcattttttgtatttttagtagagatggggtttcactgtgttagccaggatggtcttgatctcctgacctcgtgatccacccgcctcggcctcccaaagtgctgagctacctctttagaaaggtcttcctcattattcctcttgtaaaataggactcttttttgttctaaatctcaacttatttgtttcctttgtagcattcagtatcttttcctttatctctttacatgcttattgactgtttcctctgtctccgccaccaaatgtcagttccacaagggcaaagaccttggtcattgttgtatcttcagcacatagaatatatagcataatgtatatagcatggcaaatataccataaacatctatagaaataaagttctgtatttggaaaaatttttgagaaacattaaggtccctgttctgagattattttacaaatgtttacgctgtatttggaggctttgtacatcttttgttagacttaatccttactgcattaaatcagggggcatgcgatgccagattgtcccattattgatgatgctaagtttgatcacttggttaagatgtccacctaatctctatatttataaaggtaaccctttccctttcctaacaatctgtggagtgagactttgagaccatgcaaatattctgtttcacaacaagcttttatccaatggtattagcaacccttaaagttctttacaagtattcaatagtaagtacattgatggttgcaaactgattttccagttatgatccattaccctcattattccttttgatgctcaaattgtctcaaatctggccaacaggaagcccttcagaccagtttctgtgttcttttcacatgatcccattaatcttctggcacatcaagatcaccaagatcatctaagattgcctggcagtttccttgatccagccttgaaaaagtcatttctctagggagctcagattcttttgactggaaaatggtagttagagaccaagatttgggcatgggatgggctcgttattactgcagtgtaattacttctagattccctcagtgaacagtgctaagaatatgattttttaaattcctaagttctcactgacacttctaattcaactctaacattctttttgttagtattagatttctagggctactgtaacaaattcaccacacacttggtgcctttaaaacaaaagaaatttattcacttatcgttctagaggcttaaagtctggagcctggagcagaggcacaaaagagtgtgtcaaacacaaaatcacatttaaagcttctatttggaagtggtatatatgtcatgtccaatcacattctattgatcaagatgagccgtacggccatgcctaaagttgatgaggttttcaaggaaagagggaataaaaactcaagaacattaataccatctgcttcatatgctattttctgttcatttagaaattccttacattttcttgtttcagcaataagaggtgatttatgcaggcagacatgagggctgggtggcttactaggtttcttagccaggagtaccctctactgttgataaatggaagtgtaatttatttaatagatgtgaccaaagaggtttgtgggtcttgtgatttagtaattcacttttgtttttataggacagttaatttccaacatttgctttcttctttttttttttttttttttttttgagacagggtttctctctggagcaaggttggctagatttatatatttattttctacttgtaaatataaacttatagtactttttgtcttctggttattctatagatgggttatgggtggttttagtcataatttaaaattgtgtgtgtatgtgtatgtatggtttttgaagactgtggagagatttaggcagctgccattatctgacaggaatgtgcaactcctgcttggaatttttaaatgctatttaaaactatttttccaactgtttcaggtatacagaaatacaattaattttggtatttattttgttttcagcaagcttgaaaaattttaaaaattctaataatttatatataaattcctttggattttctatctatgccatcatatcttccacatacaatgagtttgtttcatcatattcaatccttacatattttccttctttttctcatcttattgcactgcttaggacagccaatatgtataatccttcagtctgtcactgtgataaattatatcagttttctaatgtataagccaaacttgcattcctagcataaatccaatttggatccatattgctaatattttgtttgggatttatgtttatgaataaaacgggcctattatcttcctttctaatattgttcttgttcggtttggttgtcaaggttatgctattatcataagataattgaataacattccatctttttccattttctgaaagaatttttgcaaggttaatattatttctcctttgaaaaattggtagaatatagttagtgtagccatctggatctggattttttaaattaataaccttttaacactaagtttggaaaattaggtaaaatggattaatccctggtaaatacaacaagaaagaacatttaatattaataagtatcctcattttttatatttttatattggcagaaatttttgtgggatctttattgatgtccagttttttaaagtttctgatattatttgtgccttcttttcatcttgattgctcttgccagaagtttgtcaattttcaaggaaccaacttttggttttctttattctctctattgtatgtttcttttttacttcatttacttcatatctttattatttccttgcttctacttccttttggtttattttgctgtttcactagcttcttgagacataccttagctcattaattgtcaggctttcttctcttccaatatatgtttttaacgctatacatttctttctaaatattgctttagctgattcccacattttaatatgtcatgccttgttatcattcagtttaaaatattttctaatttatgatttcttatttgacacatgggtttaaaagtatagttcttgattctaacataggaagattttatagttatctttcttatttatatcaactttaattgtattgtgaccagaaaacatgttttatattatctgaaatttgagactactttatttgtagcttatttgtagcttaaaatggaaaattctaacatgtttcctttgtgtgcttacaaagaatgtgtaattttgcaatttctttttttttattatactgtaagttctagggtacatgtgcacaacgtgcaggtttgttacatatgtatacatgtgccatgttggtgtgctgcacccattaactcgtcatttacattaggtatatctcctaatgctatccctcccctgtccacccaccccatgacaggccccggtgtgtgatgttcccctacctgtgtccaagtgttcttattgttcaattcccacctacgagtgagaacatgcggtgtttggttttttgtccttgtgatagtttttgagaatgatggtttccagcttcatccatgtccctacaaaggacatgaacagatcctttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtacatacccagtaatgggatggctgggtcaaatggtatttctagttctagatccttgaggaatcgccacactgtcttccacaattgttgaactagtttacagtcccaccaacagtgtaaaagcgttcctatttctccacatcctctccagcacctgttgtttcctgactttttaatgatcgccattctaactggtgtgagatggtatctcactgtggttttgatttgcatttctctgatggccagtgatgatgagcattttttcatgtatctgttggctgcataaatgtcttcttttgagaagtgtctgtttatatccttcacccactttttgatggggtctttttttcttgtaagtttgtttgagttcttcgtagattctggatattagccctttgtcagatgaatagattgcaaacattttctcccaatttgtagctcgcctgttcactgggatggtagtttcttttgctgtgcggaagctctttagtttcattagatcccatttgtcaattttggcttttgttgccattgcttttggtgttttagacatgaagttcttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattcaatagggaatcctttccccatttcttgtttttgtcaggtttgtcaaagatcagatggttgtagatgtgtggtattacttctgagggctctgttctgttccattggtctatatctctgttttggtaccagtaccatgctgttttggttactgtagccgtgtagtatagtttgaagtcaggtagcgtgatgcctccagctttgttcttttggcttaggattgacttggcaatgcgggctcttttttggttccaaatgaactttaaaatagttttttagaattctgtaaagaaagtcattggtagcatgatggggatggcattgaatctataaaataccttgggcagtatggccattttcacaatattgattcttcctacccatgagcatggaatgttcttccatttgtttgtatccccttttatttcattgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcataaggagattttgggctgagacaatggtgttttctagatatacaatcatgtcgtctgcgaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacgtttattgattttcgtatgttgaaccagccttgcatcccagagatgaagcccacttgatcatggtggataagctttttgatgtgctgctggatttggtttgccagtattttattgaggatttttgcatcaatgttcatcagggatattggtctaaaattctctttttttgttgtttctctgccaggctttggtatcaggatgatgctggcctcataaaatgagttagggaggattccatctttttctattgattggaatagtttcagaaggaatggtaccagctcctccttgtagttctggtagaatttgagtgtgaatccgtctggtcctggactttttttggttggtaagctattaattattgcctcaatttcagagcctgttattggtctattcagggattcaacttcttcctggtttagtcttgggagggtgtatgtgtccaggaatttatccatttcttctagattttctagtttatttacatagaggtgtttatagtattctctgatggtagtttgtatttctgtgggattggtggtgatatcccctttatcattttttattgcgtctatttgattcttctctcttttcttctttattagtcttgctagtgttctatcaattttgttgatcttttcaaaaaaccagttcctggattcattgattttttaaagggttttttgtgtctctatctccttcagttctgctctgatcttagttatttcttgccttctgccagcttttgaatgtgtttgctcttgcttctctagttctttaaattgtgatgttagggtgtcaatttttgatctttcctgctttctcctgtgggcacttagtgctataaattttcctctacacactgctttaaatgtgtcccagagattctggtatattgtgtctttgttctcattggtttcaaagaacatctttatttctgccttcatttcgctatgtacccagtagtcattcaggagcaggttgttcagtttccatgtagttgagcggttttgaatgagtttcttaatcctgagttctagtttgattgcactgtggcctgagagacagtttgttataatttctgttcttttacatttgctgaggagtgctttacttccaactatgtggtcagttttggatgtggtgctgagaagaatgtatattctgttgatttgggatggagagttctgtagatgtctattaggtccgcttgctgcagagctgagttcaattcctggatatccttgttaactttctgtctcgttgaactgtctaatgttgacagtggggtgttaaagtctcccattattattgtgtgggagtctaagtctctttgtaggtctctaaggacttgctttatgaatctgggtgctcctgtattgggtgcatatatattttggatagttagctcttcttgttgaattgatccctttaccattatgtaatggccttgtctcttttgatctttgttggtttaaagtctgttttatcagagactaggattgcaacccctgcttttctttttttgttttccatttgcttggtagatcttcctccatccctttatttcgagcctatgtgagtctctgcatgtgagatgggtctcctgaatacagcacactgatgggtcttgactctttatccaatgtgccagtctgtgtcttttaattggagcagttagcccatttatgtttaaggttaatattgttatgtgtgaatttgatcctgtcattatgatgttagctggttattttgctcattagttgatgcagtttcttcctagcatcgatggtctttacaatttgggatgtttttgcagtggctggtaccggttgttcctttctatgtttagtgcttccttcaggagctcttgtagggcaagcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgcgggtaacccgaactttctgtctggctgcccttaacattttttccttcatttcaactttggtgaatctgacagttatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtacactaatcagacatagatttggtcttttcacatagtcccatatttcttggaggctttgttcatttctttttattcttttttctctaaacttctcttctcgcttcatttcattcatttgatcttcaatcactgataccctttcttccagttgatcgcatcggctactaaagcttatgcattcgtcacatagttctcgtgccatggttttcagctccatcaggtcatttaaggacttctctatactggttattctagttagccattcatctaaccttttttttcaaggtttttagcttctttgtgatgggttcgaacttcctcctttagctcagagaagtttgatcatctgaagccttcttctctcaactcgtcaaagtcattttctgtccagctttgttccgttgctggcgaggagctgcgttcctttggagtaggagaggtactctgatttttagaattttcagcttttctgctctgttttttccccatctttgtggttttatctacctttggtctttgatgatggtgatgtacagatggggttttggtgtggatgtcctttctgtttgttagttttccttctaacagacaggaccctcagctgcaggtctgttggagtttgctggaggtccgctccagaccctgtttgcctgggtatcagcagcagaggctgcagaagagcgaatattgctgaacagcaaatgttgctgcctgatcgttcctctggaagcttggtctcagaggggtacccagctgtgtgaggtgtcagtctgcccctactggggcgtgcctcccagttaggctactcgggggtcagggacccacttgaggaggcagtctgtccgttctcagatcacaaactctgtgctgggagaaccactactctcttcaaagctgtcagacagggacatttaagtctgcagaggttactgctgtctttttgtttgtctttgccctgcccccaaaggtggagcgtacagaggcaggcaggcctccttgagctgcggtgggctccaccaagttcgagcttcctggccgctttgtttacctactcaagcctcagcaatggcgggtgcccctctccctgccttgcagccaccttgcagtttgatctcagactgctgtgctagcaatgagcgaggctccgtgggtgtgggaccctctgagccaggtgcaggatataatctcctggtgtgccgtttgctaagaccattggaaaagcgcagtattaggatgggagtgacccaattttccaggtgccatctgtcacagcttcccttggctaggaaagggaattccctgaccccttgtgcttcccgggtgaggtgataccttaccctgcttcggctcatgctcggtgggctgcacccactgtcctgcacccactgtccgacaagccacagtgagattaacctggtaccttagttggaaatgcagaaatcacctgtcttctgtgtcattcatgctgggagctgtagactggagctgttcctattcggccatgttggaaccacccttgtaattttgcaatttcaaggtgctattttctaaatatgtctataagatcaaacttgtgaatcatgttaattgttctatttctatacattgttccatcaattgacgagagatgtgttaaaatctagcctcccgagttcacgccattctcctgcctcaccctcctgagtaactgggactacaggtgtccgccaccacacccggctaatttttgtatttttttttagtagagacggggtttcaccatgttagccaggatggtctcaatttcctgacctcatgatccacctgcctcggcctcccaaagtgctgggattacaggtgtgagccaccgcgtccagccatgaaatcacattcttaatcttcagcaatactttcttgctttaaagtctatttttctgctatcaatagagctgtaatcgatatcttttagatatttgcataatttcttttcccatttttgtcttgctacttttctgtatctaatgttttagatatgactcataaaatgcacacaatttacttttgctttttttttttttttttaaagagacaagtctcactatcttgtccaggctgaacctcctgggctcaagtgatcctcccacatcagcatcctaagtagctgggactacaggtgtgagccatcacacccagctacttttgcttttttatcaatctgacaatctttgtcttttaactgaaatatttggtccattcatattacatatgattactgttatatttcaatttaaatataccatcttatcttgctatttttcctacctgttttatgtttctttatctctctttgcttgctttcatttaggtttgttgagtatattttatcctttcatattttttcttctaccattttgggagtcttacattgtgtgtatttctattacttactggctatcctataaactacaacattaatcaaattatgaaggtttaatattaacatctttacctcctagataatacatggattttagaatcctttattctatttatccacatgctgacttttttgctgttgtcatatgttctaaattttcacacgcacacctggcttaaacaatagaaatttattttctcacagttctggaggctacaagtccaagatcaaggggtaggcaggcttgttttgtgtgtgtgtgtgtgtgtgtgtgtgtgtgtgtgtgtattttttttttgtctgtttgttttttgagatggagtctccctctgtagtccaggctggaatgtgatggcgcgatctgggctcactgcaacttctgcctcctgggctcaagcaattcttgtgcctcagcctcccgagtagctgggattacaagcgcatgccagcatgtccagctaatttttgtatttttagtagaggggggtttcaccatgttgggcaggctggtcttgaactcctgacctcagatgatcttcctgcctcagccttccaaagtgctgggattacaggcatgagttaccacgcctggccagcaggcttggttctttttttttttcttttccttttcttcttcttctccttctctttatttttttttttagaggcagggtcttgttctgtttcccaggctggagtgcagtggcacaaccctagctcactgcacccttgtaacaagaactacaagtgcacactaccacacctggctaagggttggtttcttgtaaggcctctctcgttggcttgtaggtgtctgtcctctttctatatcttcatgtggtcgtccctctgtgcctgtctgtgtcctaatttcctcttttgctttaacgcataaaagatattttcattaggttttctttttgagagaggggttcacattgtttattttagcattgtgaagacatcattcattattttctgatatttgctattatttagaaatcagctgtcagtttgttactcattatggtaatgtacatgtcttctgacttatctattgcaaaattcgcaaacataaaatttaccattttaacaattttaaagtgtgaagttcagtgccatttagtacattcacaatgttatatagccatcaccactatctagttccagaacatttctataaccccaaaaggagattcaatacttattaagaagccactccacattcactccttctgccagcttctggcaaccactaatctgttttctgtctctatggatttgctattctgggtatttcatataagtggaatgtggccttttgtgcctggctgctttcacttagcataatgctttcaaggagcatccatgttttagcatggatcagtactttgattttttatgaataaataatagtccatatatggatagaccacattttgtttatctgttcatcacttgatgaacatttgaattgttttcacctgtttgctattatgaatagtacttctatatgcatttgtatattagtttttgttagagtgcctgcttttaattcttttgggtccacacccaggagtagaattgctgggtctatgttaattctatgttttccttactgaggaactgccaaaatattttctacagtggctgccctatttcacattctcatcatcaaggaaggttccaatttctttatattcttgctaacacttgttattttcccgcttgacattttgtttttgttttttttttaatttagccatcctagcaggtttgaaatgctatctcattgtggttttgatttgcatttccctaataactaatgatgttgtctatcttttcatgagtttgttggatccttgtatatcttctttggagaagttccattgaagtcctttacccattttaaaatttggttgtctttctgttgttgagttgtaagagttctttttatattctgggatactaggccctttatcagatatatgatttgcaatttttttctcctatactgtagatcatctttttactttcttgatagtgttctttgatgtacaaaagcttttaactttaaagatgcctactatatatatttttatagagttgttgcttgtgattgtggtgtcacatctaagaaaccattgccaaatccagtatcataacaatttacctctttgttttttcttacagttttatggttttagcttttatatttagttttttgatacatttttagttaaatgattttttacagacagggtcttgctctgacacccaggctggagtgcagtggtgcgatcatggctcactgcagcctccacctcctgggctcaagcgatcctcctatcccagcttccctagtagctgggactacaggtgtgtaccatcatgccagctaatttttttttcttgttttgtagatacagagtctcactgtgttgcccaggctggtctcaaactcctgagctcaagtgatccaccagccttagcctcccaaagtgctgggattacagatgtgagccaccacatccagccttgagttaaattttgtatatggtaaagatccaacttcattcttttgcatgtggatatccaattgtcccagcaccatttgttgaagagactattcttttcccacaaaatggtcttggcacttttattgaaaatcaattgaccatagatgtataggcttatttctggactctcaattctattccattgatctatgtgtctatatttatgtaagtactgccctgttttgattcttgtagctttgtagtaagttctgaaattgggaagtatgactcctccaacgttgttctttttcaagattgttttggctattcagggtcccttgaaattccatctgaattttaggatagatttttctattcctcaaaaaaaaaaatgtctttgggattctgatagagaatgctttgaggccggagaatcgcttgagcccaggaagcagaggttatggtgagtggagattgcaccaccacactgcagcctgagcgacagagtgagactccgtctcaaatcaaaaaacaaacaaacaaacaaaaaaacccagaatgcttgctttgaatctgcaaatggtttgtggtaatattcttatcttaagaatattatgtcttcaaatccataaatccaggatgccttttcatttatttagttatttaatttctcttttaatttttaatttttaatttttttctagttgctaattttccatatttgctgtcttcagaccagacagttctttagtttctttcaactgggtttttttgtttttagtggacaagacttgcacctccttcgttaaatttattcctaaatattgtattatctttgatgctattgtaaatagacttttctgttttccttttcatatttgtaattgttagtatataaaaatacaattgatttttgcatgttgactttgtaacctgcaatggtttttttcaactgcctaataatgttggataatttgtcttttattttcatgtttccatatgttattactttaaagattttatacataattatttcatattatgtatccgataatgtcaatatctggtgttcttcaagttttaaatctgaattgattgtttctgttcacttgtactcaagttgtcttgttgtcttgcatgtttgctgatctatgtctgtgatcttataattttaatatgtaggaatcctggaggcctaaactggaggtgctttttttctagagtaggttgagaatggttcttccaggtgccagaggataatatttatctgcaacttctctagcttccttctgggattcatgacaatgcagaattctcacactgagttctccttgcattttgctcaaggcttagtcttccagtaacaacattaatatgggcattctgtctgaggaaaggtcttcctttttatatttgctcattattcacctctccgctatgatttcagctcattattttaaaatagaagtttgtgggggtttttgttgatggggaggctggagattcccctttctttgctaaatacaacaatgcattgtcagtgatatagccttttttattgttgtacaatatacataaaatttaccattttaatcatttttaagtgtacaatttagtggtattaagtatactcacaatattgtgcacccattaccactatccatttccagaactttttcatcaccccaaacagaaactctgtactcattaaaaataactctccatttcttccccattccaagaccctggtaacctcttttctactttctgtctttatgaatttgcctgctctagatacctcattatggtggttaattttatgtgtcaacttgactgggccatggggtgcccatatatttgattaaactttattttatgtgtgtctgtgagagtgttttttggtgagattaacatttgaattggtagactaagtaaagcagattgttctccccagtgtgggtagaacttatccaatcagttgaaggcctaaatataacaaaaaggcttactgtcctcttagtaagagacagttccttctatttgactacctttaaactgggacttcagtttttttcctgcctttgggctcgaactaaaacattttaactctttctgggtctgtagcctgctggtctttgaactggaactacgaatcagctctctggggtctctaggctgccaactcaccctgcagatcttgagacttggcagactccataatcacatgagctaattccttgtgtgtgtgtgtgtgtgtgtgtgtgtgtatgtatctcctcttggttctggttttgtttctttgggaaccatgactaatacagattttcacaccaagagtgattctaaaggaacagaattttaaggataaattttataaatttgttattggatttctggaattggttctgtaacctgatgaaatttaaagacactaatgactattttcagtagtaaaaattgtccatggcatgatctggcaatagaaatatgtaggccaggctgggcgcggtggctcacgcctgtaatcccagcactttgggaggccgaggtggatggatcacctgaggtcaggagttcgagaccagcctggccaacatgatgaaaccctgtctctactaaaaacacaaaaattaggcaggtgcctgtaatcccaactactcgggaggctgaggcatgataatcgcttgaacctgggagatggaggttgcagtgagctgagatcatgccactgcactccggcctgggtgacagagcgagactccatctcaaaaaatatgtatatgcaaaatatctccattggatactcctaatcaactacttttaagaagcaagggtcttggtgactatgtatattgacacttgtgaacatatttgtcaaactaatgaatatgatgggattagtcggttgctcctaatgttgctggaaaaagtgatgaaagaaaaggaggagctcaggaatttgaattcccagctcaagagctgcataaatgacttgacagattctatgtatgccctgaaggagacccttatctactgtagccacagagctgagattgctgaaaatcaaatgccaaatctcatcctgtgactaactgaattacaaagcaagccaaactcccagctttgcagggtgtctactgttaaagcaagggcagtgattgggaaagaatggggcactacaagttggattaggtatgtgtggaagaccctgattaagctggggacattgagctcctaaatattgatgagtcttctttgtcagtgaaagttttctctccagccctgtggtggcagtatctctactccagtctaagtggattaaccctgcactgcctgaggaaactgtaatggcttcccctgaggcaactgccatgcaagataatgctgattccttcaggacccaccctaccacccctctttgttattagatctataactacactcaagtcccagcaggcgaggtgaggtatgaaggtgacccatgacaaggtgcactacactccaaaatcatgacttgagttttctaatttacacaagcaggaatccagagaatatgtataggaatgggtactaaggatgtgagataacggtggaaggcacgtaaagttggattaggccaaatttattgacatgggcccactaagcagagattctggacttaatgttgcatctcagggaattaggaaggcctctaacagtttaattggttggctgaaacacagaccaaaagatggcccacagtgagcaaactagaaatttcagacttgccctggtttaatgtagaagaaaggagattgaaatgctagagtgaatttgtcatttaagacatactcaccaacactgggagagttcagaagacacagatctcactattactttgaggaataaatttgtgaggggaacctcagcatccttgaagggctctgtgatcactcttctctgtaggtgacaccttacagcaggacctgcagtcactgaattagaaaacctaaatacaatgggaataattggatcctggggtggaaggggccaatgggcagcactcaactgccaaaggcaaggtaagtgtggttaccataagggacagcagagtcaaagcagcagttagaatagtatgacttgcacagacctatggtgttggctagtagattatagtgttcctagatgtgatatagatagaatgcctaccaaattcttgaactgcataagtggaaaagttctaggtcaagtgaacaaaagtctaacctgaataataaaaacagagtcacggcctctcaatcaattcccagacttgagcaggtttacagacccagcactccttgaatgaaggggaggctcagtctccttgaggaaggactctggtacactgccaagaatactgccactctttctctcagccttccccaaagggacatatggcctttctatcagaataaatgtgcactgaagaaaaataattaatcagacctttcagggactactggacaatggctctgaactggcactaatttcaggagacccaaaatgtcactgtggtccaccagtcagagtatgggcttatggagggtcaaatgatcaatggaattttagctcaagtccatctcaaagtggatgcagaggatctgtgagactatcttgtggttatttccccagtcctggaatgcgtaattggaacagatatattgagcagctagcaggatcttcacattggttccctgacctatggagcaggggctactgtagtgagaaatcctcctgtaatcctctgtgaataactgttctccttttgtgagatagctcttggcctactactgggccttagtagatactgaatgcttagccacagaccaccaagttgccatgtgacctgaactgcccatcatgaactaggtgttatctgacccaccaagccataaagttgggtatgaacaatggcactccatcatcaaatggaagtggtatatacatgatcatgtctgagcaggtactgaaaacacatgtaaattacatgaagaagtagcccaaatgtccatggtgcctgtttctgctaccctgccttctctctcccagcctgcacttatggccccattgggagttccctatgatcagtttacagaggaagaggagtcttgggcctggtttacagacggttctgcacgatatgcaggtactacacaaaagtggacagtcccgatctgagatacccatgaaggacagtgggcagaattttaggcagtgtacctggttgtggactttgcttagaaggagaaatggccaggtgtgcaattatatgtcaagtaatgggctgtagtcagtgctttgtccagatagggacttggaaggaacatgattagaaaacaggtgacaaagaaatttggggaagaggtatgtggacagatctctctgaatgggcaaaggatgtgaatatatttatgtcccatgtgagtgctcaacgaagggtgacctcagcagataaggatttcaataatcaagtaaatatgatgggccgggtgcagtggctcacgcctgtaatcccagcactttgggaagccaaggcgggaggatcacctgaagtcaggagttcaagaccagcctggccaacatggtgaaaccctgtctctactaaaaatacaaaaattagccaggcatggtgatgcgtgcctgtagtcccagctactcgggaggctgaggcacgagaaatgcttgaacctgggaggcagaggttgcagtgagctgagattgtgccactgcactccagcctgggcaacagagcaagactccatctcaaaaaaaaagtagatatgatgacctgttctgtggataccagtcatcctttttactcagccacctatgtcactgcctgatgggctcatgaacaaagtagccatggtggcagggatagaggctatgcatgggctcagcaacatggacttctattcaacaaggctgacctggctatggccactgctaagtgcccaatctgccagcagtagagacaaacacagagtcctcagtatggcagtatttcccaggatgatcagccagctatctggcagcaggttgattacattggaatatgttcatcatggaaggggcagcgttttgtccttcctggaaggaaactgaactactgcttcacaatggaggtatggaagagtgtgtctggaatacaatagatcccttagagtgtctcttagtattaccaggccctatgattctggtcaatgggaaactacagcaacccaatccatgcaggactactagtggcccaggctcttcaggaataaaggtttgggtcacctcatcaggtaaagaaccacaatcagctgagatgcttgctgaaggcaaagtcaatacagaatgggtagtagaagaaggtagttatcaataccagccaagttttgttatatcatgttaggtggaattatgacctcatttttgtctctacttagagataaaggagatgtgtatgatgggtgctacattgacaaggggtggacttgtcatggttaattttatgtatctactttacttggtcataaggtgcccagatatttactcaaacattattctggttatttctgtgaaggtgtttttgaatgggattaacatcgaagtcagtagactgagtaaagcagattgctctccctaatgtgggaggcatcatccaattagttgaaggcctgaatagaacaaaaagactgagtcttccccaagtaagaaagtattcttgctgcctgtctgcctttggactggaacatcagctttttcctgctttcagtcttgaactaaaacagtttagctcatccagagagacagagagagagagacagacagacagaatctcctattggttctatttctttggatatccctgactaacacactcatataagtagaatcatataatatctatccttttatgtctggcctattcacttagcgtattttcttttttttttttttttgagatggagtctcactctgttgcccaggttggaatgcagtggtgcgatctcggctcactgcaagctctgcctcccgggttcatgccattctcctgtctcagcctcccgagtagctgggactacaggcacccgccaccacgcttggctaattttttgtatttttagtagagatggggtttcactgtgttagccaggatggtctcaatttaccgacctcgtgatctgcctgcctcagcctcccaaagtgctgggattacaggcatcagccaccgcgcccggccttcacttagcatattttgaaagttcatcatgttgtggcactaatcagagatataaccttttttaaatgggaatttttcttctagaatatccaatgtctagacttcagttcaccaaactgccagtttggtgaagtctttcatccagccttgatggataagggaattcttcttggacatgatgtttacctgagacttaacgaatgagtcaggtgaaagtggcagtagagggtagctagaaaaatgttccaggtagaagaaatagtatctatttaaaagcctggtatgagatataatggctgtatttagtgacctgagaatttcttagtatggatggagcttaaagagccaagtggcaagagactgtattagagagattggtaaggaccacatcatggttaattcttggtgaaaaaagaatataaaaaataccaaagagaggaactattccttcccccattactcatggggtgataagactttatgtcatgtcttttaatcaggacaatttgttgaattatccagcaaacccagattaagaatgaagacttcctggaccactaaacttaaaggtcaaaaaggcttgggaatcaaggtgctgatgaggagaattaactcttggatctactctgcccttttctcagtattttacctttttcttaaagtcactgtgttctctcagaatgccttttacaatgtcttgctaccataggtacttaataaattttgctctgaaaatttggtcatatatcaacctttttatgttatgttaagctctaggagaggtggtattttttttctttctttctttctttccaaggagaccagcttacctttactttgccattctgaaaaaagagagtccactgatggccatcttgactgctggagatgaggaactccttcacatacatgctggtaagcagagattttactccctgagtagttactcctgtgactttcattgtcttctggaagtccacttgcagccactcttttggattattcacctgagggcaatagagttggactagtagcctcttggtcaccatttactcccagaaattcccaaatccctcttaaccataccacagcacttctcactctactttcttttttgagacggagtcttgctctgtcacccaggctgtagtgcaatggcatgatctcagctcactgaacctctgcctcccgagttcaaccgattctcctgcctcagcttcccgagtagctgtggttacaggtgcccaccaccatgtccagataattttatatttttagtagagatgaggtttcaccaggttggccaggctggtcttgaactcctgacttcaggtgatctgccacctaggcctcccaaagtgctaggattacaggcgtgagccactctgcccggcctccttccttccttcctttctttctttttcttccttccttctttcctttctttctctctctctctctctctgcctctttcagacagagtcaggcactgttgcctgggctggagtgcaatagcatgatctcagctcactgcaacctccgcctcccaggttcatgcgattatcctgcctcagcaaaagagtgatctagaactcctgaccttgtgatcggcccgcctcagcctcccaaagtgctgggattacaggcatgagccaccgcacccagcctccactttctattggctagtcagtctctcttattcaactctaagcaacttcagggccaaaatttttcacaattcacctttgtatccctaggctcatcctagggatactaagatgtgcagtaaatgtttacttttcattgatgtaatgagaaacctggaaagaaagctaattgttgatatttatctgtaaaatggactttagcttctacaattctttgacagatattagctcagtactagatatagagattcttcttccaggaggttcaattagagatcatttcccccaaatgcctgtgtggttgtctgcccataaccaaacttccttgacacactttttagaactaacagttgacagaaatacctcagaagaaacagtcaaggccttccccgattttttccccaaccactgctctgagtcagttaaacagtaaatctgttgcctcttacctgaggtctccaggcattactcctcccttggaggtgaagtcgagcttttgaaggagaccaggtggcaaacatattggtaaagtaggatgaagcagtaatctgtgcatctgatattgctttactctccattcccaatggcatgctgcaacctcaaagaaaagaaaaaagaaggttatcacaaggacatgcttcagcctcagttatactgagcagcttccactgatattctagggctactgtcatcataatatcatttctcaggttttaacttttgcacagattctgttattggttttttgttttgttttgttttgtttttgtttttttgagatggagtctcgctttgtcacccaggctggagtgtagtggcatgatctcagctcactgcaacctctgcctcccgagttcaagcgattctcttgcctcagcctcccgagtagctgggactacaggcgcacaccaccacacccggctaattttttgtatttttagtagagttggggtttcactatgttagccaggatggtcttgatctcctgacctcgtgatccacccgccttggcctcacaaagtgctgggattacaggtgtgagccaccacgcccggccaattctgttattgctatctgttttccagccagctcttcccactttgtgtgactctttaattttctttgtttcttttcttcttctacttttattttagattctaggggtacatgggtaggtttgttgcatgggtaaattgcatgtcactgaggcttggtgtatgaatgatcccctcactcaggtagtgagtgcagtacacaatacataaccttctaacccacacccccctcccaacctctcccctcctgagtgtccatcattgtgtccatgtgcatttaatgtttagctcccacttatgagaacacatgatatttggttttctgttcctgcattagttcatttatgataatggcctctagctgcatctatgttgctgaaaaggacatgatctcattcttttttatggctgcatagtattccatggtatgtatgtaccacattttctttatccaatctgttgttgatgggcatttaggttgactccatgcctttgctattgtgaatagtgctgaaatgaacatatgcgtgcatgtgtctttatgacagaatgatttatattcctttgattatatacccagtgatgggactgctgggttgaatggtatttctgggtttgcccaggactatgctggttttagcactgacaattttgtgtcctgataccgggaacccctcccccagtctcaggataactagaacagttagtcaccctacccatggttgagggaagaaggatatgggatgacttggcacttactatttaaatcacagcccatcaactccatgcgaagagtgctgcgaatgctataatgagttgggtgcaaacggatgtatcgagcaataattggagggttaaaaatattgtgttttatcccagatgaatccacattgccaaagaagacctgtatggagagattagcacaaatacatggaaagtgaatacagagtaaaaagcaatttctgtcaatcatatcttccttctaatttgctttgtgcgtttctcaacagcatccaacatctacataagacaactatggttagatggatgttacgatggtagacacaaaggaggaaagcaccaagaagaagtgggaacaaaggaaattattaggtctggggcaagtgaagttattttctactttgagttcctgtaaaaggctcataaaagttgaggaagccatttgggctctgctactccagcatggtccacagaccaggagtagcagcatcacctgagggcaattcaaaatgcagcatcaggagaacggtatcagtgagttgatgggataggaggtccctagctcttgttcccccacaggaacaataatttgacaatgatctatggacaaaagtgtctttgtgggagccttgggattcaggtaggaggttgagaaaccctggtagagctcaagaacaaagatgaatactttaataaggcaggcccacattctagcggcaggcctgtcaactgtagttctggttgtggacccagaagcagcccaccaccctggggacttagctccagagttgtttgtatgtggtcctaccactatccctatctgcccaggaatctgggaggagcaactcccattggcaaccccagtaacagggctcccaactgtggactctgaagcagccctgtacctaaagcagcttcagtaccacactaccatggtcttggggaagttttgcctacttaggaaacaggtgggagtcatgccagtccacctctggaagcaggcccaccaactagacctgactgtggactcagaagtaaccctgtgagccaactccagtcttgctgtaccatgttctggagacagtcctgcctgaatccacacttacctgtgcccccataacaggcccactgactgtgggcccaagtggggaccctgaagcagccctttgacccagctccaggcccactgcatcatggtctgcaggcagtcctgcccactcaaggacccagtgagagctacacctatccaaagccctggtaatgggcccattgtctgagtacccaacttcagaccagaagaggtgtcagctcactccaatgcacagataccaatgctaggctatgtggatcatgaagaatcaggcaaatatgacatcaccaaagggaactaataaagctccagtaaccaaccctgaagaaatggagattcatgaaatttttgacaaagaattcaaaataatcatttaaagaagctcaattagctacaagaggatacaggaagacgactaacaaaatgaggaaaacaatacatgaacaacattagaagtttaataaagaaataaaaaccataaaaaagaaccaaataaaaatcctgtagctaaagaatattgctgaatatagctgaagaatgactgaactaaaaaatttaatagcgatctttaatagcagactcaatcattcagaagaaagaatttgtaaacttgaagacaagtcatttgaaattatctagttagcggaataaaaagaacaatgagaaagagtgaaggaagaacagaggacttatgggacatcatcaagcaaaatgatagatgcattatagaaatcttaaaaggagaagagagagagaaaggaaacttatttaaagaaataataggtgagaactccccaaatctatggaggggaagtgccatctggattcattaagcccaaagataaccaaatacattaaacccacagaagtctacagtgagatgcattataattaaattttcaacaaagacaaaagagaattttggggtagtaagaagaaagtgaattgtcacctataggggagctccataagactatgagtggatatctcagcagaaaccttgcaggtcaggaaagagtgggatgatatattcaaagtactgagagaaaaaaatccaatcaacaatactttatctggaaaaactgtcctttaagaatgaacacaaagataaagcctttctcaaacaaaaactgagggggtttgtcaccatgagacctgccttataagaagtgctaatagttcttcaagttgaaataaaaaaaaaacagtaacacaaaagcatatgaatcctttcactgctaaaggtaaatataaagagaaacatagactattgtaacactataatgattgttataaatcactattaatattaatttataaattaaaagacaaaaatagtaatagtaactatagtgacagaaatttgtcaatggaaacacaatatagaaggaagtaaaatatgacgtcgattacataaagttgtggcggggggaatgagtaaagtatagagtttctgtatgtgattgaaggtgttgtcagcttaaaacagactgccataactataaagtgttcaatttgatccctgtggtaacccccccgaccgcccccccacacagtagatatacagaagataaagagaaaagaatcaaaacacatccaagcaaaaatcatcaaaccacaaagaaagaaaaagaggaaaggaacaagaaaactacaaaacagaaaactattaacagaatggcaacagaaagtcctaacctatcaataattactttaagtgtaaattgactaaactccccagtcaaaagacacagagtaactgaatgggctttttaaaaagccaacaattcagagatgggaagtaagaaacaaaaataaacaggacccaactacatgttgttgataacagactcacttttgatttaaggacatacataggctgaaagtgaaggggtggagaaagttatgccatgcaaactgtaaccaaaagagagcaggggtggctatacttgtatgagaaaaaatagtctttaagtaaaaaactgtgacatgagacatagaaggtcattatataataaaagggtcacttgaacaggaagatgtaataattataaatatatatgtacccaacacgaaagtacctaaatatataaagcaaacattgacagacatggaaggagaaatagataacaatataatatagttgacttcaatactccactctctataatgaatagatcatcccaacagaaaatcaataaggacaaaacagaactgaagaataaaatagacccaatggacctaaaatgtatatacagaactttccacccaacagtagaattatcaagcacacacaaaacattcttcaggacagatcacctttcaggtcacaaaacaagtcataataaatttaagaagattaatatcataccaagtatattttctgaccacaatggattgaaactacaaatcaataacaataagaaaacacgaaaattcacaaatatgtggaaactaaacaacacattcttgaacgaccattgggtcacagaagaaaccaaaatcttgataatataccaaaacttaaaggatgcagtaaaagcatactaatagggaaatttatagcaataaatgcctatatttaaaaagaagaaacatatgaaataaacaacccaacttatcacctccaggaactacaaaaagaagaaaaaaaaaactaagcccaaaggtagcagaacaaaggagataataaatgctagagcagaaataaataaaaaagagaataaaaaaacaattggaaataactgacaaaactaagagttgatttttttgaaaaaataaacaaaattgacaagtccttatctagactacgaaaaaaagagagaagactcatataaataaaatataaatgaaagaggagacactacaactgatgtcacagaaacagacagaaccataagggactattataagtgtcaacaaattggttaacctagaggaaatggataaattcctagaaacatataacataccaaaactgaataacaaagaaatagaaagccttaacagactaacaacaaatagggatattaaatctagtaatcaaaaaccttccaacaaagaaaagcccaggaccaatggcttcatggatgaattccatcaaacattcaacgaagtattaataccagtatttcttaaactcttccaaaaaatacaagagagaacacttcaaaatacaatttattagccaacatcaccctgataccatatccaggcaaaaacaacactagaaaagaaaactacaggccaggccaggtgtggtggctcaagcctgtaatcccaacactttgggaggctgaagcaggcaaatcacttgaggtcaggaattcgagaccagcctggccaacaaggtgaaaactcatctctactaaaaaaatacaaaaattagctgggtgtgatggcatgttccagtagtcccagctactcaggaggctgaggcaggagaatcgcttgaatccaggaggtggaggttgtagtgagccaagatcataccaccactgcactccagcctgggtgacagagcaagactctgtctcaaaaaaaaaaaaaaaaaaaaagaaagaaaaagaaaatgaaaagaaaagaaagaaaactacaggccaatatccctgatgaacacggatacaaaaatcctcaacaaaacaccagccaaccaaattcaacagcacattaaaaggatcattcatcatgaacaagtggtatttatccctaggatgcaaggatggttcaacatgggcaaatcaatcaatgtgatataccacattatcagaatgaaagatgaaaaacacatgattatttcgatcaatacagaaaaagaatttgacaaaactagatatccattcataataaaaactttcagcaagatagatacagaaggaacttaacacaataaagaccatataggaaaagctcacagctgatatcataaccaaatgtggaaaaactgaaggtttttccttttagatactgatatggtttggctctatgttcccactcaaatctcaccttgaatcgtaatccccataatgcccacatgtcaagggagggacctagtgggaggtgattggatcatggggatggtttcccccacgctgttctcctgatagtgagttcttatgagagctgatggttttataagtgtttgacagttcctccttcacacactctctcttgcctgctgccatgtaagatgtgcctatttccctttctgctatgactgtaggtttcctgaggaaagaacatgggacttatgggacagccatgcagaactgtgagtcaattaaacctcttaaagcttcataagtgaaggagaaatgaaattctttacagacaaccgaatgctgagggattttgtcaccatcagacctgccttacaagagctcctgaaagaagcactaaacatggaaaggaacaactggtactagccactgcaaaaacataccaaattgtaaagaacattgacactatgaagaaactgcattaactaatgggcaaaacaaccagctagcatcataatgacaggatcaaattcacacataacaatattaaccttaaatgtaaatgggctaaataccccaattaaaagacacagactggcaaattggataaagagtcaagacccatcagtatgctgtattcaggagactcatctcacttgcaaagacacacataggctcaaaataaagggatggaggaatatttaccaagcaaatggaaagcaaaaaaaaaagcaagagttgcaatcctaatctctgataaaacagactttaaaccaacaaagaccaaaagagacaaagaagagcatcacataatggtaaagggaaaaatgcagcaagaagagctaactatcctaaatacatatgcacccaatacaggagcacccagattcataaagcaagttcttagagacatacaaagagacgtagactcccacacaataatagtgggatactttaacaccccactgtcaatattagattaatgagacagaaaattaacaaggatattcaggacttgaactcagctctggaccaagcagacctaatagagatctacagaactctccaccccaaatcaacagattatacattcttctcagcaccacattacacttattctaaaactgattacataattcgaagtaaaacactcctcagcaaatacaaaagaatggaaatcataacaaacagtctctcagaccacagtgcaatcaaattagaactcaggattaagaaacacactcaaaaccacaaaaatacatggaaactgaacaacctgctcctgaatgactactgggtaaataatgaaatgaaggcagatataaagatgttctttgaaaccaatgagaatgaagacacagcgtaccagaatttctgggacacacttaaagcagtgtttagagggaaatttacagcactaaatgcccacaagagaaagcaagaaaaattgaaaattgacaccctaacatcaaaattaaagaattagagaagcaacagcaaacaaattcaaaagctagcagaagacaggaaataactaagatcagagcagaactgaaggagatagagacacaaaaaaaccttcaaaaaatcattgaatccaggagctggtttttttgaaaaaatcaacaaaatagatagacttctagccacactaataaagaggaaaagagagaagaatcaaatagatgcaataaaaaatgatattggggatatcaccactgatcccacagaaatacaaactaccatcagagaatactataaacacgtctatgcagataaactagaaaatctagaagaaatagataaattcctggacacatacaccctcccaagtctaagccaggaagaagttgaatccctgaatagacctataacaagttctgaaattgaggcagtaattaatagcctaccaaccaaaaaaagtacaggaccagacggattcacagacaaattctaccagaggcacaaagaggagctggtaccattccttctgaaactattccaaacaatagaaaaagagggaatcctccctaactcattttatgaagccagcatcatcctgataccaaaacctgacagagacacaacaaaaaaagaaaatttcaggccaatatccctgatgaacatcgatacaaaaatcctcaataaaacactggcaaaccaaatccagcagcacatcaaaaagcttatctaccacaatcaagttggcttcatccctgggatgcaaggctggttcaacatatgcaaatcaataaacataatccatcacataaacagaaccaatgacaaaaaccacatgattatctcaatagatgcagaaaaggccttcgataaaattcaacaccccttcatgctaaaaactctcaataaactatgtatcggtggaacatatctcaaaataataagagctatttatgacaaacgcacagccaatatcatactgaatgggcaaaaactggaagcattccctttgaaaactggcacaagacagggatgccctctctcaccactcctattcaacatagtattggaagttctggccagggcaatcaggcaagagaaagcaataaagggtattcaaataggaaaagaggaagtcaaattgtctctctttgcagatgacatgattgtatatttagaaaaccccatcatctcagcccaaaacctccttaagctgataagcaacttcagtaaagtctcagggtacaaaatcaatgtacaaaaatcacaagcattcctatacaccaataacagacaaacagagagccaaatcatgagtgaactcccattcacaattgctactaagaaaataaaatacctacgaatacaacttataagagatgtgaaggacctcttcaaggaaaactataaaccactgatcaaggaaataagagaggacacaaacaaatggaaaaacattccatgctcatggataggaagaatcattatcatgaaaatggccatactgcccaaagtaatttatagattcaatgccatctccatcaagctaccactgactttcttcacagaattggaaaacactactttaaacttcatatggaaccaacaaagagccctcatagccaagacaatcctggacaagaaggacaaagctggaggcatcatgctacctgacttgaaactatactacaaggctacagtaaccaaaacagcatggtactggggccaaacagatatgcagaccaatggaacagaatggaggcctcagaaataacaccacacagttacaaccatatgatctttgacaaacctgacacaaacaagcaatggggaaaagattccctatttaataaatggtgttgggaaaactggctagccatatgcagaaaactgaaactggatcccttccttacaccttttacaaaaatcaactcaagatggatcaaatacttaaacgtaagacctaggaccataaaaatcctagaagaaaacctgggcaataccattcaggagataggcatgggcaaagacttcatgtctaaaacaccaaaagcaatggcaacaaaagccaaaattgacaaaggagatctaattaaactaaagagcttctgcacagcaaaagaaactatcatcagggtgagcaggcaacctacaggatgggagaaaatttttgcaatctatccatctgagaaagggctaatatccagaatctacaaagaacttaaacaaatttacaagaaaaaaacaaacaaccccatcaaaaaatgggcaaaggatatgaacagacacttctcaaaagaagacatttatgcagccaacagacatttgaaaaaatgctgatcatcactggtcattaaagaaatgcaaatcaaaaccacaatgagataccaactcacgccagttagaacggtgatcattaaaaagtcaggaaacaacagatgctggagaggttgtggaaaaataggaacgcttttacactgttgatgggagtgtaaattaattcaaccattgtggaagacagtatggcgattcctcaaggatctagaactagaaataccatttgacccagcaaatcccactactgggcatatacccaaaggattataaatcattctacaataaagacacatgcacatgtatgtttactgtggcactattcacaatagcgaagacttggaaccaacccaaatgtccatcaatgatagactggattaagaaaatgtagcacatatacaccatggaatactatacagccataaaaaaggatgagttcctgtcctttgcagggacatggatgaagctggaaaccatcattctcaaaaactatcacaagatcagaaaaccaaacactgcatgttctcactcataagtgggagctgaacaatgagaacacatggaaacagggagtggaacatcacacgctggggcctgttggggggtggggggctaggggagggataacattaggagaaatacctaatgtaggtgacgggttgatgggtgcagcaaaccaccagggcacgtgtatacctatgtaacaaaactgcatgttctgctcatgtaacccagaacttaaaatataatttaaaaaataaataaaataaaaagcatccaaatagaagagaatagtaaaattatctctttttgcagatgacatgatcatacatgtagaaaactctaaagactcaaaaaaaaattgttagaactaatacatgaattctgtaaagttgcaggatacaaaatcaacatacagaaatcagtggtgtttctatacactataaaatatcccaaaggaaattagaaaataatcttatttacaatagcaacaaaagaataaaatacttaggaatagacttaaccaaagaaatgaaagacttgtacaatgaaaatatagaaaacatttatgaaggaaattaaagaagacacagataaataaaagatattccatattcctagattggaagaattagtattgttaaaatgtccacactacccaaagtaatctatagatttgatgtgatccctatcaaaatctcaatggtgttcttcacagaaataaaaaaaaaattttaattaatatgaaatcacaaaagaccccaaggaggcaaagcaatcttttttttttttttttgagacagagtcttgctctgttgcccaggctggagtgcagtggtgcgatcttggctcactacaacctctgcctcccaggtttaagtgattctccacctcagcctccagattagctgggatcacaggggcctgctaccacacctggctaatttttgtattttttcagtagagacggggtttcaccatgttggccaggctgctcttaaacttctgacctcaagtgatccacccacctcagcctcccaaagtgctgggattacaggcgtgggccaccacatgcagcctggcaaagcaatcttaagcaagaagaacaaagctagaggcatcatacttcctgatttcaaaatatactacaagtctccagtaatcaaaatagtatggtactggcataaaaatagacacatcaaccaagggaacagaatagaaaagcccagaaataagttcacacatttacagtcaacagatttttgacaagggtgccaagaacacacaacggggaaaagagagtctcttcaataaatgatattgggaaaactgaatatccacatgcagaagaaagaaattgggcccttttctcacactatacataaaattcaactcaaaattgattaaacacttgtatataagacctgaaactataaaactcctagaagaaaacaggaaaaaagctacctgatattgatttgggcaataatttttttatatgacaccaaaagcacaggcaacaaaaacaaaaatagaaactgggattgcattaaactaaaaactttctgcacagcaaaagaaataatcaacagagtgaaaagacaacctatggaatggatgaaaatatttgcaaactgtatatctgataatgggtaagaaactcaaacaactcattagtaagaaacaacccaattaaaaatgggcaaagaacccaaatagaatttttcaaaagaagaaatataaaaggccaacagataaatgatgctcagcatcactaacccacagggaaatgcaaatcaaaacacaatgagatattccctcacatctattagaatagtgtcttagtctgttatggactataacttattatggactctaatttattatgctgctatgacagaataccacagactgagtaatttgtagtgaacagaaatgtatttggctcacagttctggaggctgggcagtccaagatcaagaggccagcatctggcaaaggccttctttctatatcataacatggcagaagggcaaaaagagggcaagagagagcaattcaaattcacagccttaggtgcttttgtaatcggcattaatccattcatgagggtggagtcctcataacctaaacatctcccattcggccctacctcccaacactgtcgcattgggaattaagtttccaacacatgttttttggggaaaacactcaaaccatagcaaatagctattatcaaaaagacaaaagatgacaaatgttggtggtaatgtggagaaaaggaaacctttgtacactgttgctgcaaaaataaattggtacagccattatgaaaaacagcatagaggttcctcaaaaaaactaaaaatgaataccatgtgatctggcaatctcacttctgttatatatccaaaggatacaaaatcagtatgttgaatatctgcactcccatgttcactgtaacagtattcacaatagtcaagatatggaaacaacctaagtgtgtccattgatggatggagggataaagacaatctgatatatatatatctgatggaatattcccacaattataaaatattatttggccttaaaatagaagaaaatcctcccacttgtgataacatggatgaacctggaaaatattatgctaagtgtaataagccagacactgaaagaaaaatacttcatgacctcatatgtggaatctaagatggtcaaactcataaaagcagacagtagaatcttaggtgctagggactgtggtgtgggggaaacagggagatgttgatcaaagggtacaaaatttcaattatgcaagataaattagttctggagatctaatgtacgatatagtaactatagtaaacaatattgtatacttgaaatttgctaaaagagtaggtcataaatgttctcaccacaaaaaaaggtagctaggcaaagagatagatatatcttaattagcttgcttgtggtgaccatttcacaatgtatcaaacatcatatatgaaaaacaaaatatatcaaaacatcaagttgtacctcttaaatatatgcaacttttgtcaattatacctaaataaagattttttaaaagagatgcagttccttgggcaccatgtcagttctactgaatcagaatctaaattttaataagacccttagctgtttcataagcagtaaagtttgaaaacactggcagaggacacagtcagctgtgaaagagtactgggaatgcacagcctatcctccaccctggtctcagaatgatcttctaagaatgtagtgtgtgtgtgtgtgtgtgtgtgtgtgtgtgtgtgtgtagagagagagagagtctataatgtgggcattaatgaatgatcccactgtatgaattaatgagacacgttagtatccaaaacgtgggatttgacaccttgacatgtctgggttctggacaaaattacataacatattcaagagaaagggaatacagtttgagaaatatggtagtaatgccaattcgaaaggcctagatttaaaccatggcatacagcataagaaatactgaaaatgatatcactcatagaacacctgggattttttatctgcttgaatacactaaaataggtatcagtgtaagtctattatatgatcacacatcagtttagtatcatgggaattttttttttttttttttttttgagacggagtctcgctctgtcgcccaggctggagtgccgtggcgcgatctcggctcactgcaagctccgcctcccgggttcacgccattctcttgcctcagcctcccgagtagctgggactacaggcgcccaccaccacacccagctaatgttttgtatttttagtagagacggtgtttcaccgtgttagccaggatggtctcaatctcctgaccttgtgatccgcccacctcggcctcccaaagtgctgggattacaggcataagccaccgtgcccggctggaaattttaaaaaattattctgccatgtagcatttttttcttcccagggaatagaaaatattaataaatttgtggctttgttcctaaacaagttataccagaaatcacaatattcttttttataaatatatctgtattggggggttaaaatagaatgaataacatattcaaaccatataactttgtttaaagatttaccaaggattttgttttctctgctgctctcctttctatataggagaaaatttgaccttctatttatggcctttagatttggcttttgcaagagctagtataattaaatcccaggtaataagtaaacactccaaaccacctctctggggtgggatggtgcaaaatcatttgtagaaagctacctgtttcgtctagctacctcctgcgtaagtgggtactggcagctcttgggggcctgaattttatgtctcattttgactaaaataatgaatgtgtagtctgactccaaaaggggatagtcatctttgatttgagataggtctcgttatgtttccaaatttctgatttaaaagaaatttgttgctacagaataatcattgagaagtagaagaagttttgaaatgaagtatatatcaatgtaaaatgccattccgttttatcagcatccaaaaagtttatgttgaacttaagagtattatatagctaataaatgttgatcattaacttgtgactaaaccgtatgtgctaggaagaatatgatctctcagtgatgtccacattttaatccccagaacatttgactgtgttatgttgcatggcaagagggatttaaggttgcagatggaattaagtttgccaattagctgatgtcaaaatagggagaatatcctggattatccaggtcggcccaatgtaatcacaagaggccttgaaagtgagagagagaggcagaagaggagagtcaaagggagacgtgactacttaagaatagtcacaaaggtgcaatgttactggcttcgaagatggaggaaggaagccatgagttaatgaatgtgtgtggcctctagaagctggaaaagaaaggaaaaaggatccttttctttttctttttttttgagagggagtctcactctgtcgcccaggctggagtgcagtggcgccatctccgctcactgcaagctccgcctcccgggttcacgccattctcctgcctcagcctcccgagtagctgggactacaggcgaccgaaaaaggatccttttctagagcttccagaaagaaatgcagccctgatgacaccttgattttagcccagtaagacttgggtcagtcttctgccctatcgaactgtaagataataaacttgtgttgttttaagccatattaagtttgtggtaatttgccaccccagcattagaaaactaataccctgtatacattggctttgccttcattcgttactcaatctttgtgccttgattagaaacctgcttggggagacaatttattaattcaacaaatagttaatgactgactatacaaatcctagattccatatattatgtgccaggcattgtgctagaaggcctcactggtaaattctactaaatgtttaaggaaggattaacattaatccttcttaaactcttccaagagacagaaaaggagagtaaactttacaactcatactatgaggccaccatatcttgatatcaaagccagacaaatatatcacaagaaaagaaaattacaaattgcatgtaattgaatatgtgagtataatattcccttatgcatctaggtgcaaaaatcttcaacaaaatattagcaaaccaaatccagcagcatgttataaaggttatagcccatgctcaagtggaaattatcccaataatgcaagactggttcaacataagacaatcaatcccccagtcaactccacattaataaaatatagggaaaaaaacccctgcaagttcattctggttgatgcagaaaaatcacttgataaagctgagcaccttttcatgaccaaaaaaaaaaaaaaaaaaaaaaaccactaagcaaactagaaatggaagagaaaatccacaacatgataaagagcattcataaaatacccaaaactaacatcacactcaatggtagaagactgaaagatatttccctaacattagaaacgagacaagaatgcctgcttttactgcttctattcaaaattgtattggaagtcttagccagagcaattaggaaaaaaagaaataaaaggcatccaaattgaaaaggaataagtaaagctatcttattctcagatgaacatgagcttatgtatggaaaaccccgaagaatccacaaaacactatagagctaataaacgaattcagcaaagttgcaagatataagatcaacgtgcaaaaatcagttgtatttctacacactagcaatgaacaatctgagatgaaattaacaaaataaaaaataattctatttaaaatagcatcaaaaagaataaaatacttaggaataaattcagctaaggaggtaaaagacttgtacactgaaaactacaaaacattgctgaaagatattagagacagcataaagaagtgaaaatatatcctgtgttcatgaattggaagacaatattattaagatgatagtactacccaaagtgatctacagatttaatacaatctgcatcaaaatcccaatggccattttttttttggcagaaatggaaaagccaatcttaaaattcatgtgtaattgtgcaagacctcaaatagccaaaataatcctaaaaaataacaaagctggataactcacatttcccaaattcaaaacttcgtataaagctacagttatcaatgctttgtggtactggcataaggacagacatatatataaatggaatagaattaagaagcaagaaataaacccataaatatattcatgggtatgtacctcaaatatggatggttcccagcttataatggttggacttacaatattttgactttatgatggtatgaaagcaacatgcattcagtagaatccatatgcataaaagtacttaaagtacacatacaaccattctgcctttcactttcagtgcaatattgaataaattacgtgagatagtcaacacttcattataaatttggctttacgttatatgattttgcccaactgtagcctaattgtaagtgttctgagcatgtttaaggtaggcctggctaaattatgatgattggtaggttagccgctgatatggtttggctctgtatccccacccaaatctcacatcgaattgtaatccccgtgtgtcagaggagaggcctggtgggaggtgattggatcatgggggtggatttccccttgctgttcttgagacagtgagtgagttctcatgagatctgatggtttaaaagtgtatgacatttccgtccttcactctctgtctctcctgctccaccatggtaaggcgtgcttgcttcccctttacctgctgctgggactgtaagtttcctgaggcctcacagtcatgcttcctgttaagcctgcagaactgtgagtccattaaacctcttttcttcataaattaccaagtctcaggtagttctttatagcagtgtgagaatggactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatcgtactcaaagttctagtcagggcaattagtcaagaaaaagaaataaaaggcatccagatcggaaaggaacaagtaaaaccatctctattcatagatgcatagatggcatgttcttatatagaggacactaaagagtccaacaaaagaaaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcccggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtctagaaatgcgcagacatggaattagggtcacgagtttcgtttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggattttttttttttttttttttttttttccccccgagatggagtctcactctgtcgcccaggcaggagcgcagtggcgtgatctcggctcactgcaacctccgcctcctgggttcaagcgattctcctacctcaacctccagggtgcctgggattacaggcgtgcaccaccacgctgggctaatttttgtatttttaatagagatggggtctcaccatgttggccaagctggtctccaactcctgacctcaaatgatccaccctcctcggcctcccaaagtgctgggattacaggcatgagccaccacgcctggcctgtaatagggattttgctgcaacttttagttaagtaggtgaaatcagagtgcgtggccctttggtgttgtgcgatcacgtgactgcaaggcagcctccgtgttcccccaaagcaggatggcgttccgtttgagaacacttaagtttccaaggctttctggctcaaatggagcatgccccccaactacgctgttttcttatttattgcgtctttttaatccttttgatggtgacaacaagaactcttcagaatatagcctctttctcaaactttcaaccctggggaaatgcatcctttgggccgaagttgcacacaatcctgatcttcggggctgagatgtaaggacacagtttggagtaggtgtttttgttttgcgtctttttgcaggggagaggtgtggagggttgtcactgtgagttgagtgcctccaaatgggtgggacttgtagggtgttcttttctgcttctatttctatttcgacagtgtggaagtaatgggaagcacaggagaggcccattccaccatcattcctctttctctcacttggctgccaggaagggtcctacggagccctgaacgcctagcccaaattattgtaaaagcggttgaagggctcatgctcctttgctctttggctctttcctggtatgctcctcttaacccgggctgcagacctggccggctggcttcttgtcaggttcaggagttacggagcatgactggtgaccagtttgggatttgggcttcaggagaagcctccttaggcctctggtccaaactccttgcgtcagggaggtgaggggaaggataaccagacggtcaggtagtgggtatctgagcataattctaggaaacactaaaactcctcgttttccatttgccgtgggctcattcatgtatctccctcagaagcttaagagcagtgataactgggccgaggccagatttcagcagttttgagaattccctcgtaatgtatcacatcagtatcaaaagtcaacactgatttctagcatgccaaaagcaaatactttcagaggacatgattagtttgctttttaacttgaaaacaattccaaattcacacttaaaacagtgtaaaccgtcggaaatggtggcagcgaagcagtgaacccttaaaggctgttggggttccccttctccccattgtgaggtattcccaaaaggataaatgttgcttatgaaagaatattttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttattttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaaactttttaaacatcataaaaagtatttgaaactaacagtgaacattatattaaacagtgaaacacaggttacattctcattaaagtcaagagcaagacaggcttatttgttatgtgtttaccagatcctgtcagcataatgtcatcagtgtaatggacaggcattgtgcttgtgggatgtaaagatgtttgaggtcccttgagtctatattatgatagaaaacaagagagctaacattgccctgatgcatgggcagtaaacttaatactcttgttcctacttggtaaattcaaatgtattctgattttactaatgtatggaaatgaagaaaaaacattctctaggtcaatacttccatatcaggtgcctggggctgtgtaaatttgcttcaacagagatatgatatctggaattgcaattgttttttggcatcaccacctgattaaatttgtgatctgctgtcattttctgtgactcgcctggctttcgtagtgtccaaacagggtctctaaggagaatagtcactggtttgtgaggcacctatctcagttatagccactgaaaggcttttacacaaaagagggatgactgcttcagagactggggagtggttgcctcctcaggcaaaggaggttcaggggaatttggaggtttgcaattctcagcctcatccatgtctgcctaaatgcctccatctcaggcctcagagtttcactccttcccaccggtactcttaccacagcataatagatctggtggagttaagcatttaattgtcactgcagctctgcaacttatgctcagcccctaagtcgtatctgcctacaaccacaggatacggagtattcctcaaaagctctatgcatgcatcctgattttccatgtatgttcatcagtgttcttattttgtatatattcataacatttcatttctttttccatgtgtatgccctctagggctgtaagaagacagaccactctacaatcaggtaatgctacgtttgttgccacagtgactaaatgccactgtcatttaatctccccagtgtcttacttgccatctgcaactcatcccatagtatcactggtgataatctgagaaactataatactaacacatgtcatggattccctaactgctcattttcttccttggcaaatatgttatctctgtgtttcttgaatatattagcaacataaccttagaattgcattttgaaaatctgtttcctggggtttcttctagcaccaattactgtatgaaacaagggatccagcaaggaacagaaaacatggaaattaggataatttgtggaaggtttaataaagatactagttaggagggtgggaacagagtattaccatcctgtaaacccaaaataaaattctaatcccccctcctttcggcaaagggccttccaaagttaacctgaaaaacgttcaggccatgatgggaaagtggggatcaaatatgccttattatacccgcctcccttttggaattcagaaaaatctgaccagcattaacatcaacacagaccttcagactgatagaacagactctttaagtctgataagaaacatttacaatctattctctctgaagcctgctacctggaggcttcatctgcatgacagaaccttggtcttcacaaccccttatcttaaccccgatgttcctctctattgattctaagtctttacacaataacttaactctttcaaccaattgccaatcagaaaatctttgaatctacctacgacctggaagccccgcctcgcttccagttgtcctgcctttccaaactcaatgaatgtacatcttccatctattgatttcggtcttatgtctccctaaaatgcgtaaaaccaagttgtagccagaccaccttgagcacatgttctcaggatctcctgagggctgtgtcacaggccattggtctctcatatttggctcataataaatctcttcaagtattttacagggtttaactttttgtttgttgacaatccctaaacctgaaaggatcagaagagagaaacatcctgaaagagagaattggatagattattgtagtggctttaaaaaatgaccaccaattatttaacatttctcccattaaaaattagggtctatgtctcttccccttgaatctgggtggatatgcgatttgcttataaccaatagaatgtattgaaagtgaggactaaactctgatttttttttatcttgcccaaattcctatctaaggggtctggggagtcatgccctacaaatcataaattctcatcagatgggttttatttaaccttatatgtcatgatttactttccaaccttactctggcataacattatgagacaaggaagaaaatcaaaatattttaccccaaaacatgtttttttgccatattttgaaatggccctgcaaagctgttctttgtggagggaaatttgcaactgtaaagaatctctattaacatagctagatctttttctcccagcccctcccaatcctaaagagattaactaagatctgaatacaaaacatttgtcatctattgtctctaaggggagccactataagacttcaaaagaactttggtctccacaatgtttatcttaacctgaacattccctttctatcaatcccaggtcttcagacaaactcaaccaattgtcaaccagaaaatgtttaaattcacctatagcccggaagcccccaggttgagttgtcccgcctttctggaccaaatcagtgtatttcttaaatgtatttgattgatgtctcaagcctctctaaaatgtataaaaccaagctgtgccctgaccatcttgggcacatgttctcaggacctcctgagggctgtgtcatgggccatactcactcatatttggctcagaataaatctcttcaaatattttatagagttcaacactttttgtcaacaaaagtgatgctacataacttagaagactcggtcagaaaaggttatgtagtcttcaccttgttaactgtaacactcacacttggaggccctaaaatgacgtgtaagaagtccaactacaggccgggtgcctgtaatcccagcactttgggaggctgaggtgggcggatcacctgaggtcaggagttcaagaccagcctggtcaacatggcaaaaccctgtctctactaaaaatacaaaaattagctgggtgtggtggcatgagcccgtagtcccagctactcagcaggctgaggcaggagaatcacttgagcccgggaggcagaggttgcagtgagccgagatcacaccagtgcactccagcctgggcaacagagtgagactctgtcctccccccaccttcctaccccccctcaaaaagaagtccaactaccttgaaacatgctgtaaggaaggccaggcctcagggataatccatgtaaagttacatcagtcaacaaccccagattctgtcctagctgacagtcagtaccaaccaccagaaaagcaagagaaggaacttccagatgattccagcacccagctgttaaataatcctaactgaggctccagaaaccacccatccccactgtgtcccagtcttgatctacagaatctgtgagcaaaacataatggttattgttatgacagcaagttttgaagtggcttggtacacagcaatagtagctagtacaggtagaaaaagccactctgagggaaacagtgaccttaagtggggagatacagtgaactcctctgcaaggagaaagtcagaagaataaatatgccaatcttttgccagtgctccctgttggtgaaatccaaccaaaagctggaggacaaggtaacctgttgatgtattctatacaagctcacctcacagaacaagaagcagggtagagaagcaggaaaatggatctaaaggggcaaacaaaagttatcttgcttggggtcatttgaagactttgaactttattctaaagacaatgggaagacattgaaaagttttaggcaggcgactgatgattatcctgaaaatgatgtgcagcttttatcggagaacagattagaaacgggggaagactagttaggaatgtaatacaatagatcaagtgtgaggtgatgggaccctgggctgtggcaacagcggtataaatggaaacagaagaaagagatgtgagaggcattgcaaataaaggattgaccagatttgtgggcataaaaatgagggaagagtagacaataacgctgaggttttaagcctttaagggtcttgagctcacctctagagaattcatcaattcccaaagtttcacccatccttttatgtggaagtcatgaatcttcatctccatccatggttttgccccctaaacttgtctttcacctactgcctgctggacatttcaacctgattgtcctactataacctcaaacctaggatatccataagcaagctcacaatcatcaatccacacagtcctgaatcacatatttctatcaatacagcatctcttcatttctatcatctatgagccttgacactactacatttttgctgatatgtccgtaataactctattgctcataagtgaaaaattattttttggaattaagtttgtggaagctaagagtgtttgtccaatatctgaaatctgccaaaattctttaaagtattcaggcattccctttaaatgactaattacataccattaaggttccagtggaatttcctcgataagtctgccacttcttcccatcaagactatacatgatgataaactgagagatgtagaggctggagaacttctgacgggcaccctgggtcttgatgccgtgaataatcattggtgccaacagatccacctaccaattaaaataacactttattttaacctatttttaaatgtatgtgctacctcctgaaactaattattagcttaggaagaatctacattgctacaggtgtgtccatcattaccttaggtgtgcaagtgaagcagtcaccaatgttgaaatgtgcatgtgtgtgtgaagctgtgggatacacagtagaaatgaatggaaagatgcttattgagttcccagcctgcttcttgacaaaccaaaccactaccaaatcattgagcccccatttcgtacacacacacacacacacacacacacacacatacacacaaacacacacacaccttttgtggactcacataagctaatggacccacataagctaatgctttgcccacacctcagcctcagaccaaagccaatttcctcccctctcctgaaaccagacccaccccaacatcactgtcagtgatgaactgctacacctccttcaagtgttagttcagaaactatttttcctggttagccttctctgactcacccagacaaatttagtgctgcttcttctatgcttctacttcactttgtatataacttcattatagcaaattattgcaccatattataaggttgctttgcttttctgctttccttattagactgagatccttaaggcagtgaacccatttgagtcacctaactttctgtgtctcaacttatctgtaaagtgaagataatattagtttttatctcaaagggctgccataggggttaaagagttaatacatgtaatgtgctgagttcagggcctggcgcatactaaacactcaatcaatgttagcttttatattctctctagccccagcacctaatatggtatctggtataatactgctgtatagcaaatgctttggaatgaatgagtgaataatgggaaagtagtacagaatggacacttcttaaagaagaggtcatgggctgcaagaacattagaagtatcagttactgtcctaataagcaagtcaaatttagcacgttttcacacatgcctgacacacacaattggactggtcatcactcttatgcttaataactgtctccttcagctgactgtaagttccattcatacactcattcaaagaatattttttagcacttgctatgtgccaagcactgttttagatacagggaatagagtagtaaacaagaaagaaagccctgccctcatggaacttacagttgagtaggagaaatagaccttatatcatatatgtttttatttgtttatagcatcaagtagtgataagcgcaggagaaaaatgaagcagggtaacaggacagagtgtcaaggtcttcagaagttgcagccctgtcttttcccagatagatggtattcccaatcaaagacacttcattttaacctcttggtattgtggcataaaaaagtgaaagcaccaggcacaaaaatcatgatttctactgaattgacttttactgtttcttcatatagatagagtataagagttctttcttggaccagtgattattgtattttccagcagccttgctagaataaagctgcaatagaaccaggctacaataaagccttggcagcctacctacattctgcaactgacaaatgcttgacaactgatgaatgcttgacaaactgccaggcttatccacttcatcttcttgtgcctcttctacattataattggcacctgggagcagtttgacaattacagactcaacagcttcacctatgtgcccagccaggtgtttcagtgtaactacaagacacatctctctactaggaagtaagcaaggtggtaatgagtttcactgtataaaagtacaaacactgcagctgcgtatctccatggggcctgctgacttccccctgtgcattgcctggtcttggtcacctggtgctcctcaagccagcccagtgctcttgtgtcttggggccaggctgttgtgcactcttcaggccttctcacgagaatagatgccttctccaactcccttccttgtcagcaccccctttcaactccatctccatggtttattttataaagttacgagatctataaaaagtctagctggaccttagtaggacagatggcaaaaccaccttgaagataaggcgattcaatagtggtagatgataacataactaggtggatttgtaactggtttaattaccacaagtgaacagtgacagttaatagatggttatcaacttaaagggagcattccggaaacagtgtagtacaacgattaccagttagggttctggagcccaactatcagaatttgaattttggctcagtcacttattagccatgtgacttgggccacaataacctctctatgcttcaatttcattatctgaaatgaagatgatagtaacatctacctcacaaggttgtagtaaggacttaacagcttgatttgtattgtgcacatactaaggaagtcttgtctacttcaatattttgatcatgactttgctgcagtattagaaagtttactgatcaaatcagtaactggaaaaactaggaaatactttgggacactgaagatcggcaagctgaaacaatgggccaaatctagtaagtggaaacaacagagtatatcattcagggttcattggctaggcacagacaggacactctatttactagtcttatcaggttgtatctagtgaggaagatataattccgccctcccaaataagaatgttattacaaaaaattaaatagcacagacagacacagggtggccaaatagataaacatgttctctatatagggatacacttaaggttgaaaataaccatagaaatacaaggtgaagaacataacatgttgtttggcagaagcacaaaccaacaaaaaatacttagggattagtgaacagcagctcagattgagtcaaaattggcagtgtctacaaaacaatgctgtggcattaatagacatgctatttgcaaagatggaaaccaaaatgttttctccatttcctgtttgggcttctagaaggcatctagccttatgtttaggtggagaggctgagcaggcacttccaagctgccctcagcttttgtgaggcatggaagagacccaagagtttccatctgtctgtctttgaaggggcctcattgatcatatgttgaaatgatagtattttcagatatgttgagttaaataaaatgtattattaaagtgaatttcacatttttgaaaacgtggctacagaaaatgtaaaagtacacatgtggtttgcatttgtgaaccatttgttttatgttaaaataaaggggattggagtacttaaggacacgtgggcagttggaagcatctaataataacatatactgtcttgagagatgacgagttcaatattatagaaaatattcagatgttctaatcccagtagaaggactaaaatacagaaacaggacatatcaatatactcaattctatccccatatctctttgttcatgactgcttttgtacaaatcattaaggcattctgttctttagttttctcatattcatagaatcctttgagcttgcaagaggaataagtaatgcaattgattgaatgtgatacatttcccatcattgattacattttctaaccttgatccaagaaaagggctccttggtgctccaggcattgattgatccggaataatgaagtctggccagctttggggcccactgtcctttgcccaagtaaagaaacagagattaaattcagctgggttagtcctagacacttgagaataaaattattgtcttgagaaaggttaatctaagctgtggtgaaaatagagaaaaacataaaggctttatggcataccagtatcaattactatctaaggatattgcttatccttgttgtccattttattttctaaaatttataattttgttaattgttagcacctctaactagctgatactgcaatttgttaccaacactaccaaataataatattatttcttcttttctttctttttttgagatggagtcttgctttgtcacccaggctggagtgcaatggcatgatcttggctcactgcaacctccacctcctgagttcaagcaattctcctgcctcagtctcctaggtagctgggactacaatcgcgtaccaccatgcccgactaatttttgtatttttagtagagacggagtttcaccatgttggccaggctggtcttgaactcctgacctcaggtgatctgcttgcctcagccttgcaaagtgctgggaggcatgagccaacgtgccccgcctattatttattacgcaatgtatgttcattgtagaaaaatcagaaaatgaaaagtaaaaattagtaaaaatacaaataaaagacattttaaaatgtaacccttccacctagtgaaaaatgttactattttggtgtaaaactctcacgcctccttttcaagaggatttttttttacctcacaacaacataggttggcaaactttttctgtaaagggccagatagtaaatcatttaggctttgcatattatatggtctctgttgcaactatgttactgctgctgtagccatagatgatatgtaaattaatggacgtggctgtgttccaaaataaggctttattacggatgctgaaatttgaattttataatttcacatgtcatgaaatagtcttcatctttttgacaattatttaaaaatggaaaatctgttcatagctcacatgccatacaaaaacaggcagtgtgctgcatttagcctgtgggcagtagtgctctaaaacaatttctgagaattctctatagaccctagtcaaactttaccattactgctcataggaaagtatagcttcctgctgcactgaaaagaattgactcaaggaagaaatactgaaggtagggaggatatttaaggaggcagtgtcattgcccaggtaagaaatgatggtgacctgagttaagatggccacagtgggaagtggagaggaggagatgtatttgagaggcacttatggaatagaactaatagaagcatggagatggattcattatctgagattctccaccagattattaaaaaaagatataatcagcccaggttcttggagcaaaaataatagtatttaccatattgtcctgaagctgtaatctgaaaatctctaatgtgtccagaagccattcccaggggagtctgacactctgaaatgaaacgggtggaacacagtaactagaagtgcacaaaattcagcttctcaaatgtaagtcaatgaaaatgggagaacgtcaacaaatgctattttttagtgtttaaatgtgccaagaactgtactcaacgttttactgtattagttcatttaattaatcctaacaggtgctagaatgattcacattttacagctgaagaaactggggtccgtacataaatagaccagtggctctcttacttgtttagggttaaatctccaaactcttccaagtagtatttctaagttatctggtaactaaatcaacattaaattccaaaatctgctactggagatcttcgagctttaccaagttgtgaaaatgaggtggtattttttttttgtcaattatttagagcttcaggtacaaagtgttcaaagcttcaagtatatctgccctactctgagaactctgatgatttctaccagcaatattcattttaaatttgataatgatgtaaacttgtatttatttcctgacacaagcaaccattccagaaaggaagaaagctgtaaagaagtaggctgagtaggtagggaacctctgcccacattgctactcactattgctgtacaccagaaaaagtgtgctcatcccagcatgtagatgctcgccaataaggcattccacccgccaaattccagctttggatggtaacatttccactgtctcaaaaacaccttataaaaaccaacaggaacagaaattatttcttttcactaaaaaatgagcatgagatacattggtttatgcgaaatatcagagtagacctaccaaatttggtagttccactacttttggacccctcaaatgcaaagtgcttgctacgtgacccttacagttgggggttgtggagattgagttctgaccactcccctccccccaggagatgagaaacagggtgactgaattctttgatggttgggacaggagaatgctactgcattatgattgacctacattcccagggtctttctgagcaaaaggtgtgtttcccattggccagatgtggactctgtgaaacagataagtcagggtgagttccctctggatccagtccactagagctgcctacaagggtaaagttaccccagcaacaagaagctgcaggtgaacactgagggctgagaaatgagtcacaagtgaccacccagagtaaaggtggaagaaatcatgtcaaggggatttcatgacagtcacgtaagggagtctctaaagagttccctgaaagtgccctgcaggagaaagagtcaacaagtattgccaggcacaaacagtgttaagctagtttacaacaatggtgccagctgtaaataggtaagaactatcttatccccttacctttaacctatccatgttggagttcaaaacagcagctataaaggggttgtggggaagcacgatcatcacaaggtacagaaacagaggactcaaccatgtctcccttttccaatgcagacttccagcctgatgcaggctcaagttggaggaggggagattgaagttaaatcaagtttacaattttgattaatatcttgggatggacattgtaatttctgatttgaactgtatttgtgacataaagtgactttagtcctgtttattacttaagggtgagcagaaaagttacagggcttatcagaatttttacgaagaaataaggaaagtttacccccgctattaaactggatggttttttttttttagagacagggtcttgctctgttgtccaagtttgagtgcagtggcactttcatagctcactgcagcatcaacctcctgggctcaagcaatccttccacttcagccacccaagtaggtgaagtagctgggactacaggtatataccacatgtctggctaattattttttgtagagatgggggtcttgctttgtcacccaggctggtcttgaactcctggcctcaagcaatcctccaaccttggcctcccaaagtgctgggattacaagtgtgagccatcgcacctggccaaatctattttaaagggacagtgaagaaccaaaataaaattgtgttgtgatcaacattatgagtagtgcttaatcaatatactggttacatacataaacaaatgactctttggatgactactggtgccctatgggatttgagatggtaaatgataaaggaataaattccttttccctaggaaagtactgtgacattaattatccatttattctgttctatttcctttttagcaatttttctatatctgaaattatcttgttcatttgctttgaacaaatggtttaaaaagcatttgaaaaagtattacttaagagcatggagcttgtctgctttgatcactgattgtgttcccagtgcctagaccatttaaagtaagtactcaacaaatagagtaggtagaagaaagagcacaaacaagctcatacctggatagagattgtacagtgccattttatactcctctttttttcgtacagtgaacacatgtccactgaaatgaatagaatggatgttttcattgctgcccatgctgagcagataccatcgaatcctttgatcctgagccattactaagccaggtagtgtatccattatgtagccattgattgctggagaaggacacagagaagcctgttaaaatctattatataagtttctttctctccactccaccaaaaaaactgacatctatgaggattccactcccacagatatactctaaataaatacaatgttcaagtccctggatcaagtctcatttgtcaaagtgcaatctgcatttcacagtgataatgtttggatgtggaatatattaccatggaagcgataattctctttaaaagtgggatcttccatctggatattgcagggagccctgcagtttctttccatattttcagtgaagtaccagcttttggtctcatcaaagatggtgaaaaacagagcaaattcctgtactgtcacttgtctcccatgagcagggttcagtgtgttagtgtggcagaccagaaggggtccaatcaggcctgagtgcacatctttttcctagggagggaagacatcaatcctatgagtataagctctctcacctatgaaccagagtggatttctcatcaatttttatgccagtccaacctgcctcccaccttccaaaaatataatccatcctcttcagtagattccagaatgacatttctaaaacacaaatataatgatcaactctcctatttaaagcttcttattgcacgtaggataaatatcaaaattcttagtacacaaagaccatttcttttaaaccaaaaagtggtcagcacaatagacacctgcttaccaggtcaacatcagagaaataagcccaggctttgcagtcaaactcatctttagtgggtgccatatgatgttgcactttccaaaagtaagttttggtttcattaggcttgacaaagttttttctaggttctgctccttgcctctgatcttcctcataagaaataaggctagaatagaaggaatagggacgagaggcctgatttctgaaagttacctgtagaacaataacgacaaaaaaaaaaaagcaagaataatcttctaggatcttaaggtccttagggtttacatccctaaaagaaatacctgtcttttggtctttatcaaagtttttaataccctggaagaagtggtacagaagatggatgctgttagaactcaaacctaatcctgaggaggttttgtattctaaatttaaggtatgaactcaaagttgcaaaggagaaaattcctaaacacataaaagccattccagagtaaaagggaaaatgttactgcaggggttataagagaccataacgccaggagttgatatgtaagttaaggttcttcatgacaaattctagaatgaatgcatattatcttttaaaaaaggcttactttccagattaaaaattatacatatttatcatagaatataatggaaagtaaaataaaatgtaaggcaaaaattgcccacaattccataattttagatccttctacatccttaatatacaccatcaattaattgaaacaacgaatagatattttcagaaaaaaataaaactactttgatctttggttcacacaatgcaccaaaataacttttagtctacaggaagtattaaaaagttaaatgtaaaaaattaaactgtaagagaaaaactgaggaaagtataggtgttttttaaaaaatctctggataggcaggaatttttataaacataaaagcaatgaaagtgtcaaaaagtaaagattgatgggttactacctaaaaattaaaacctgttttatttcaaaaaccatcatttataaaattaagagaaaacaaaaacttgaaaaagtacctctcattaaaatgttcagtggtttactatctaatatataaggtaacataatcaataagaaaagcacttcctccatgaaagacaaatgtgcaagggacattaccaaataattaataagaaaaactcttaagatgctcaaatacattgcacttctggaattttatcttagaaaaactgttgtgattacagcgttatttatatagtgaaaaaagaaactgtctaaaagcttgttcaaaataaatggttacataaactatggttccataaattcatataatagactattatgcagtattttaaaaacatacataggaagtgtttttaatgacgtaagaaatgtttatgatgtgatatttagtaaaaaaacaagaatcagaattctgcatggtataatttgaatacataaggagaaaaatacataggaaaaatagaacgtacacaaagataattatggaattatttttctatactttaaaaatttccaaaagtgggaatacattatagtcagcaagaaaataaatatataaaattaattttcttgtaattccactgtccttaactcaccatgatattatcttcaacttctgctcttatatatggccccaggagtcccaaatgttcatttagttctccacggtataagggctgagtaaaggagccatcagtaaattcctggaaaacaactttcttgaactgagggacactgccactctgagccctggagaaaaaaagcagaggaaaagcaataattttatgtaccaagtgggtagaaatgcctcacatcctcattttcctaggtgcctgagaagcattttgcatagttaaccacttcatcttccttgaaatactcttgccaagctttattagcatgtaagttccatgaaagctggggttttgtctgttttgttccctgttgtattcccagcacctgtaacggtgcttggcacaaagtaggtgctcaaaaaatatttgtcgaatgttgaatgaatgtaaagtttataaacatactccaaatataagagagtcccatggtcaagcccttggatctcttttctttttactttttaaagccctattaaaattgtgaactaaaaaaattgtgaactaaaacatatacaataaagtgcataaaacacaaatgcctttggtacataaatgcaatcatcacccagatcagtaacattgccaacaacccacaagactcactggatgtcccttttcaatcatactttctcccttcccactgaaggtaaccaccattctgatctttatgataatcatttctttgcttttctttataattttaccagttacgtatacatcctttaaaaatatagtttagttttgcctgttttgaagtgtgtaaataaaacatactacatatattcttttgtttcttctttcacttagcattctggttgtgagattcatctatattatcatatgtagctatagtttgttcattcccattgttgtatagtattatatgaatataccctaatcacggacatttgagttgttataatctttggcactttcatatggacctgctataaccttctggtgcatatcttttggtgaacatatatgtgcatttctgttgggcggaattactaggtatgcatgtgtttggctttggtaggtattgccacactgttttccaaagcagctggaccattttccattttcattagcaatgtatgagagttccatttgctccaaattattacaaatatctggtattgactgtgtttttacatttttggatgttctatgaggttgagcatcttttcttatgagtagcagtcatttggatgtcctcttttgtggagcacctatccaagcttttttctgccaagttttctcttggataatctgcttttttcttgttgaatcaaaagagtaccctatatatccttgatatgcttttttatatattccttgattgctggagaagaaggacacagagaagcctgttaaaatctattatataagtttcctttgtgtgtcctttgtgttatgtattgcaaacatttaccattccgtggctaatcttttcattgtttttatgttatcttttgatgagcataagtttgtaattttaatgtgtggaatttataaaaaaaaaccttattggctagggctttttgtatcttgatgtcaattctctttctttccctaccctgtggttattgatatattcttttacattttctttctaaaatgtttatgattttatatttcacttttagacttgtaatgcaatgtgaatggatttttgtgtatggtgtgagttaggaatccaatgtaatgttttatctatatagataccaacattttccagcattttattgaaactctacttctgtgacacctttgtcataaatcaagtttctatatgtgttagactagttttggattttctattctatttcatttacctgtttgattatccctataccaactgctacattgttttaattattatagctttaaaataagtctcaatatattagacagcaattactctcatcttattcttcctcttcaagaaggacttggctattcataaacctttacattttcatattaattttagaatcagcttgttgagctctacaaaaggaacgtcttgggattttcattcaggttgcactgaatctataaatcagtttgggaataaccgacattttcaaatatcatgttttccaattcatgtacgtggtatatcttgaaagttatttaggtactctttaaagtttctcagtaaatttccatagtttttttttccatagacattttgcaaatttttagctagacttatttctaggtacttgttagtattctattccactatttattttgtttttacttcctcattgtgtctcaccaagctgacacactcaaacttaactttccccctggtcaggactctcctagaaagtggctctcttggcttatgaccattctcaagggagagacctcaagactaaattagaaagaaaccatagcaataaaaatcacaatgggggtcatcttccagcttctaaccagaaggaaatcaaccaccttcagctcagcaaacctgcaagcaatgtgagctgtgtgacaatccaacagaggtggagagccagcactgatttgggctggatggttcaggaagccagctgcttccgttggcgagtcattttcgctgtcacaagccatattgccatgataaacatctttgacagacacattcttgacactgaagcccacattgtccccaagaagagcttcatttaaagcttcatggtgcaattcaaaagactttatttcagttgtaatgttaactggagcaaagctgaccaatcatgctgggtttgagggcaccagtcaccactaggcccacaaagacattaccaatactaccaattttgtagacttcctggagaggtaggcacaagccttgtcagttggatgagctggtggtatgatataatccagagcttcaagcggtgtgctacactggtattgccatctctgcaggtgactctccaccctttaaccaaggcatgttagcaagttgtcagcattccaaccagaaattggcataaatactactgtgttgcggttgtagccagtattcttaatgtagggctgacttccttattgatttccacatagctctgttggcgatggcatagttcagtgaaatccattttttaacaccaacaattagttgtttcacttccagtgtgtaaaccagaagggcatgctcatgggtctgcccgttcttaaagatactagcttcaaatttgttaacaccactagcaataatcaggacagtacagtcaacctgagaggtgcctatcatgatgtatttttaaattgatacacgataattgtacatgttttggggatacatgtgatattttgatacatgaatacaatgtgtaataatcaaatgatggtaattggaatatcaatcacttcaaccatttgtcatttatttgtgttgggaacattcccagtcttctcttctagctattttgaaacatacaataaatcattgttaactatagtcaccctactgtaatatcgaacactacaacttatcccttctatttaagtgtaattttactgtggggaaaagaaagagagatcagactgttactgtgtctatgtagaaagaagtagacataagagactccattttggtctgtactaagaaaaattcttctgccttgagatgctgttaatctgtaaccctagccccaaccctgtgctcgcagagacatgtgcggtgttgagtcaaggtttaatggatttagggctatgcaggatgtgctttgttaaaaaagtgcttgaaggcagtatgcttgtccatggaatactatgcagccataaaaaaggatgagttcatgtcctttgcagggacatggatgaatctggaaaccatcattctcagcaaactatcacaaggacaaaaaaccaaacaccgcatgttcttagtcataggtgggaattgaacaatgagaacacttggacacaggagggggaacatcacacaccggggcctgtcatggggtggggggagggatagcattgggagatatacctaatgtaaatgacgagttagtgggtgcagcacaccaacatggtgcatgtatacacgtgtaacaaacctgcacgttgtgcacatgtaccctagaacttaaagtataataataataataaaaaaagtcatcaccattctctaatctcaagtacccagggacacaatacactgcggaaggccgcagggacctctgccctggaaagccaggtattgtccaaggtttctccccatgtgatagcctgagatatggcctcgtgggaagggaaagacctgaccgtcccccagcccgacacccgtaaagggtctgtgctgaggaggattagtgaaagaggaagtcctctttgcagttgagataagaggaaggcatctgtctcctgctcgtccctgggcaatggagtgtctcggtgtaaaacccgattgtatgttctatttactgagaaaagagaaaaccgccttaaggctggaggtgagacaggctagtggcaatactgctctttaatgcaccaagatgtttgtatacgtgcacatcagggcacagcacatttccttaaacttatttatgacacagagacctttgttcacatgttttcctgctgaccctctctccactattaccctattgttctgccacatccccctctccgagatggtagagataatgatcaataaatactgagggaactgagagaccagtgccggcgcgggtcctccgtatgctgagcgccggtcccctgggcccacttttctttcctgtgctttgtctctgtgtcttatttcttttctcagtctctcgtcccacctgacgagaaacacccacagtgtttctcgtcactgtgggtgacgaggggcaggccaccccttcattttacacctattaatcaacctctcttcattccatcccacccccccataccattcccaaactcctttaagcaccattctactctctatctccgtgagatccactttttaagctctcacatgtaagtgaaaacgtgatatttgtctttctatgcctggcttatttcacttaacacagtgacatccaggctcatcgatgttgccacaaatgacaggatttcattctttttaatggctgagtaatagtctattgtgtatatataccacacagtctttatccattcatctgttgatgtatacttaggttgattttatatcctagctattgtgaatggtgctgtaataaatgttggtgtgcaactatctctttgatacactgatttcctgtctttggatatatatccagcagtgggattgctggatcacatggtcgttctatttttagtttcttgaggaacatacatactcttttccatagtatctgtactaattcacactcccaccaatagtgtacaagcattccccttttgccacatcctcatcagcattcattattttttgtctttttgataaaagtcatttaactggagtgaaatatccattgtgcttttggtttgcatttatctggtaattagtgatgttgagcagtttttcatatacctgttggccatttgtatgttttcttttgagaaatgtttattcagatctttgttcatttttaataggatcctttgcttttttgccattgacttgtttgagttccttatatattctggttattaataccctctcagttgtatagtttgcaaatatttcatcccatcctgtaggttgtcccttcactttgttaattgattcctttgttgtgcggaagctttatagcttgatataatcccgtttgtctacttttgctttagttgtctgtgcttttgatatttcccaggccataaaatatttcccagaccaatgtcctggagcatttccccaatgttttcttccagtagcttcatactttcaggttgtatatttaagtctctaatccattttgatttaatttttgtatacagtgagagataggggtttagtttaattcttctgcatgtggatatccagttttcccaacatcatttattgaagagactattctttcaccaatgcatattcttggcactttgtcaaaaatgagttggctctaaatgtgtggattcatttctgggttctctgttgtgttccactggcatatgtttctgtctttatgccagtaccatgctgttttggttactacagctttgtagtatagtttgaaataaagtagcatcatgcctccagctttgttctctttgctcaggactgctttggatatttagggtctgtattagtctgttttcctgctggtataaagaactgcctgagactgcataatttataaaggaaagaggtttaattgacttacagttccacatggctggagaggcctcaggaaacttacaatcatggtggaaggtgaaggggaagcaaggcacctttttcacaaggtggcaggagggagaggtgacagaaggggaaatgccagatgcttataaaaccatcagatctcatgaaaacttactcactgtcatgagaacagcatgggggaacctgcccccatgatccaatcacttcctactgggtccctcccatgacacatggggattattttgccttacatgaaatgtaaggcaaaaattgcccttgcccacaattccataattttagatcctcctagatccttaatataaacaatcaattaattgaaaaaatgaatagatgttttcagaaaaaaataaaactactttgatctttggttcacacaatgcaccaaaataacttttagtctacaggaagtattaaaaagttaaatgtaaaaaattaaattgtaagagaaaattgaagaaagtattgtttttttttaaaaaatctctggataggcaggaatttttacaaacaatatactacaattcaagatgagatttgggtggggacacagagccaaaccatatgtttccacccatggcccctcccaaatctcatgtcctcacatttaaaaacagaatcatgcctttccaacagtcccccaaagtgttagctcattccagccttaacccaaaagtccaagtccaaagtctcatctgagacaaggaaaatcccttctgtttatgagcctgtaaaatcaaaagcaagttagttccttcctagatacaataggggtacaggcattgggtaaatacactcattccaaatgggagaaattggccaaaacaaaggggctacaggccccatgcaagtctgaaatccaatagggcagtcattaaacctgaaagttccaaaatgttctcctttgactccgtgtctcacatttaggtcaccctgatacaaaaggcaggctcccacagccttgggaagctccacccccatagctttgcagggtacagccctgctcctggctgctttcatgggctggcattgagtgcctgtggcttttccaggcccacggtgcaagctctcagtggatctaccattctggggtctggaggacagtggccctcttctcacagctccactaggcagtgccccagtggtgactgtgtgggggctcccaccccacatttcttttcctcactgccctagcagaggttctccacgagggctctgcctctgcagcacacctccgcctggacatccaggcatttccatacatcctctgaaatctaggtggacattcccaaacctcaatttttgtcttctgtgcacccacagaacaaaggctgggggcttgcaccctctgaagctatagcccaagctgtactttggcctcttatagctggagtggctgggacacagggcaccaagtcccaggctgaacactgcaggggagccctggacccaggccacgaaagcatttttccctcctaggcctccaggcctgtgatgggaggggctgctgcgaaggtctctaacatgccctggacacattttccccattatcttggtgattaacatttggctccttgttaattatataaatttctgtagctgggttgaatttctccccagaaaatgggtttgtcttttctactgcatcatcaggctgcaaacttttcaaacttttatgctctgtcactctggaatgctttgttgcttagaaatttcttctgccagataccccaaatcatctctctcaagttcaaagttccacagatctctagggcaggggcaaaatgctgccaatctctttgctaaagcatagcaagagccacctttattcctattcctaacaagttcgtcatctccatctgataccacctcagtctgaacttcattgtccatatcactatcagcattttggtgaaagctattcaatgattctctaggaagttccaaactttcccagattttcctgtcttcttctgagccctccaggtctctaggaagttccaaacattgccacattttcctgtcttcttctgagccctccaaactgttccatcctctgcctgttacacagttccaaagttgcttccacattttcaggtatccttatagcagtgccccccctacctcggtaccaatttactgtattagtctgttctcatactgctataaagaactgctggagactgggtaatctataaaggaaagaggtataattgactcacagttccgcattgctggggaggtctcaggaaacttgcaatcatggtggaaggcgtaggggaagcaaggcatcttcttcacaaggtggcagtgggaataagtgccagcaggggaaatgccaaacacttagaaaaccatcagatttcatgagaactcactcactatcacgagaacagcatgggggaaaactgcccccatgacccaatcacttcccactgggtccctcccacgacatgtggggattatgggaactacaattcaagatgagatttgggtggggacacagccaaaccatatctgggtcttttgtggttctgtacaaattttaagactgctttttctatttctgtgaaaaatgttattggtattttgataggtaatacatgaaatctagtagtattgatattttaacaatatgaattcttccattctatgaacatgggatagataccttttcattttttgtgtgtcttcttcaattcctttcatcagggttttacagttgtcagtatagagatctttcacctctttggttaaatttgttcctagatatttatttttattatagctattgaaaatgaaaatgcttttatgatttctctctcggattgttagctcttggtatatagaaatgctactgatttttgtatgttggttttgcttcttgcaactctactgaatttgttgatcagttctaacagttttttggtggagtgtttaggtttttctaaatataacattatatcgtctacaaacaaggggaatttgatttctttttttctaatttgaaggccctttgcttaattgctccatcttggacttccaggactgcatttaatagaattgatgaaagtgggcatgcttgtcttgttccagatcttagaggaaaggctttcaattttttcccatttggtgtaatgttagctgtgggcttgtcatatataacatttactgttttgaggtatgctcctttaaaccaaatttgttgagagtttttatcatgaagggatgttgaattttattcaatgctttcttgacatttattgaaataaatatatggtttttgtctttccttctgttaatgtggtgtatcacatttattgatttccatatgttgaactatctttgtgttcctaggatgaatcccccttgggcatgacaaatactcattttaatgtgttgttgaatttagtttgctagtactttgttgaggatttttgcatctatattcatcagcgaagttggcctgtagttttctttttgctgttgttgtgtctttgtctggtttgggtattgggataatgctggtcttgtagaatgagtttggaaacattcttttctcttcaattttttgcaatattaaatagtttcagtataattggtgtaagtttttcttcagcagtgaagtcatcaggtcctggacttttatttaatgccagactttttactactgcttcaatctcattactagttattggtctgctcaagttttctatttcctcatagttcaatcttggtaagttgtatgtgtccagaaatttatccatttcttctagtttttccagtttgttggcatatagttgatcataatagtttctagtgaaactttgtatttttgtgttatcagttttaatgactcttttcatctttgatttcaattatttgggtcttctctcattttttttccttagtctagctaaagattttaaattttatctttcaaaaagccattttaaaaatttcattggtctttcatattgttttctttttctcaatattatttatttctatgattattattattattttccttctactaattttgggtttggtttgctcttgtttttctatgtccttgagttacatcattaccaggtttatttgagtctttcttttttgatgtaggcatttatagctataaacttctctcttagtaccgcttttgttgtatcccattcattttggtatgttgtttccattttcatttgtttcaataaatttccttcttaatttcttcattgacttattggttgttcaggagcatgttgtttaatttccatgtatttgtatagtttcaaacgttcctcttgtcattgatttctagttttattctactgtagtcagaaaagatacttaatataattttatttttttaaatgttgagacttgttttctggcctaatatatagtctatcctggagaatgttccatgtgctgataagaagaatgtatattctgtagtagttggataaaatgttctgtaaaatgtcaggtaggttcatctggtccagagtatattcccggatgaactggagctcctttatatgttatttgcttcttttttcttgctctttttaggatcccctctttgtctttgacctttgagagtttaattattgtatgccttggggtagtcttatttgggttgaatctgtttggtgatcttcagccttcctataactggatacttacatctctctgtaggtttggaaatattttctgttatttctttgagctttttattcattgctctttctctcttgaaggcccatgactcttagatttgttctactgaggcagtcctctagatcttgcaagtgttcttcattccttttaattattttttgtcctttgactgtgtattttcaaatagcctgtctttgagctcattgattgttcgttttgcttgatcagttccgctgtttagactttccagtgcattttttttttccgttcagttgtatttctcagctccagcatttctggttttttaaattattattttgatttctctgttaaatttatctcataaatttctcagttgcttttttgtgttctttgagtttcctcagaacttttattttgaattattgatttgagagctacaatttgccatctcattagggttggtcactggctccatgctgtttccatttggagaggtcatagctccctatttgctcttgttttttatgcacatatatctatgtctttgtatgaatgctaagttatttattccagtctttgtgtctggcttagtttggtttttcaggagtatgcctgtctaaaggttatgtatgaattagagcttccttactctgagattactgcctcttttttggcactagatggtgctgtaagcccagatttgctgcagctcttgcaacggcttggattactgcctattcccgatttgggggaggtcccaaactggatatcctggttgggtgagacatctggttaggattttgtgtccagaggaaccacgggctgaacattctctctcatttggtgtcttctttggcttagatgaagagcagccaatgtgttttgcatgctggggttgctagccccgcctccatcctttgtctctagctgccctcaggatttttttaccctagaggcaatcaggctgcttcccacggattgaggcaggaatgatttttctgcaaaggaacccaagatggtgggaaagctggctcttcatctagatgtcactttttctgatgtacatactgtcagtctgggggaacttttctgcatggtgcctggcagcttgggaaggggatgctgcagttaaacaggcccatttttgttatcttctgcttgcagtttttctcttctatgtggccactcagatcctcacagcctctgttttgagttatgggatattcctggtgataagctagacactgaatagttgtttttggtttttctggaggagagtgaagccagattgcttctatccaccattttggtgatatcactctaatcatgtttttttttttttttttttttttaataaagcccctgtgtgctggggcatcaatgatggtcacaggatatttttggcctcaggtttctttaggagatatcaatggtgatattccattcatgttcagtttatagttatccaagacccaagcatactcaaatgagccctttcccatctcagcaggttctttctcaaatttttcaatggttcctttgttgatcacatcacatttatagatcagatgaccagtagtgttgaactttcctgagtctacatgtccaacgttgatgatagtgacatgaaccttttcctttcccaattttggcttagatttagcagtgattttcatgatacttgtgttatgacagcaaaccaactgtgaataaagcaattctatatatcttaacgctcataaaacatttgaccatgttttatgatacttatctctatttatccacatatttaactttgtttgctctttatcccatcttgtctctcatgccttccattctgtatcacttttttattgtctcaagtataacattagaatattttagtggacttttgctaatggtgaagtttctctgtttatgcttgtctgaaaatgtatttctttcaccttcattcttcaataaaatattttttagattttcatttttattattatgttagagcaagtgaagtagcagcaaaagtgtccatcatacaatctggctttccctggtcctcagggcaaggaggaaacttgggcagcagacaatcactcaatcctggcagactctcagaatctcacttggaccctaaagtgcatctgcttggtggcattgttcttcatttctgtcttcagcatccattttgacttcatcctttggatataatgcatgtctcactttcatgtaacagctgctcctgtgttgccagtctatcccagggctctctattactgaagcactcggcccatggcctcacaatatttagcaactaccacagctcttgacaagccaaatcactgtttgtagtatctcatcaaggagtgatgacccactctggcatcagaaggcagaatcagttccatgctttcatcatcatattctaagtcctttcctaagggcgactcctcagcctcattagggtcctccccttccttgtgatctgggtagctactcctaaactcatacaagtctgcaaattccaaagcagcatcaccatctgtaaaaagcttacaccagcttttgtcatatgtgcctgtacagcttctgttgagtagaacttccccttctcattgcaacacaagcaaatcttctcaacacaaactttctctcccaagtaattaatcagtcccttaagatctgaaagatattctatatcagtaataaagaagcagtggactttggtcatacttgtgtcattttgttaattgctttctttctttttttttttttagatcctttgatcctttcttcttctgttgcattcttcctttatagtttgatggctttctgtagtggtatgctttggacctttttaaaatgttttgtgtatctactataggcttttgctctgtggttactatgaggcttacacaaaattagcaggctattttaaactgataacaacttaatttttattgcatccacaaactctacacttttattcccttcctcctacatattattattttttttgagacagggtcttgctctgttgcccaggctggagtgtagtggtgtgatcattgcttactgtagccttgacccccccaggctcaagcagtcctcccacctccacctcctgagtagctgggactacaggcatgcaccaccatgctttactaatttttaaattttttatagagatgagatctcactatcctgcccaagttagtctcaaatgcctgggctcaagtgatcctcccaccttggcccccacaaagtgttgggattacagccatgagccactgtgcccagcctattttatgtttttgatgtgacagtttacatattttaataatttgcattccttaacacattattatagctttagtttttaaaatagctttctttgtcttttatcttttatactaaagatataattaatttacccactgccattacactactagagtgttttggatttgacaatgtacttatttttactagtgagttttatcctttcatatgttttcatattactaataagcatcctctttcttcagcttgaagaactcctactagcatttcttataaagcagatctagcttttgtctttctgagaaaatctttatcaccccttcatttctgaaagataaaattactggatatagtatttttcattgctagtttttatttcctttcaggattttaaatctatattttcactcccttctggtctacaatatttcttctgagaaatccactaataatcttatacaaaggatatgaacagacacttctcaaaagaagacatttatgcagccaaaagacacatgaaaatatgctcatcatcactggccatcagagaaatgcaaatcaaaaccacagtgagataccatctcacaccagttagaatggcgatcattaaaaagtcaggaaacaacacgtgctggagaggatgtggagaaataggaacacttttacactgttggtgggactgtaaactagttcaaccattgtggaagtcagtgtggcaattcctcagggatctagaactagaaatgccatttgacccagccatcccattactgggtatatacccaaaggactataaatcatgctgctataaagacacatgcacacgtatatttattgcggcactattcacaatagcaaagacttggaaccaacccaaatgtccatcaatgatagactggattaagaaaatgtggcacatatacaccatggaatactatgcagccctaaaaaaggatgagttcatgtcctttgtagggacatggatgaagctggaaaccatcattctcagcaaactatcgcaaggacaaaaaaccaaacactgtatgttctcactcataggtgggaattgaacaatgagaacacttggacacaggtaggggaacatcacacaccggggcctgttggggggtggggggaagagggagggatagcattaggagatatacctaatgtaaatgatgagttaatgggcgcagcacaccaacatggcacatgtatacatatgtaacaaacctgcaggttgtgcacacgtaccctagaacttaaagtataataaaaagaaacaaaaacaaaacaaaacaaacaaacaaaaagaaatgttctttacatcctctctcctcattcttcccatactcaattaacagccagtcttatatgcttatctttaattatacccaacatccttccatttctttccatttctgtcaccaccacactggtctaaataactgtcttcttttatctgtatgactgcaatagcatcttaactggtatctctgcctccactcttgcccatggatgctgtgtgacacgattccatataatcagtctttcctagagtcctagagtttggatataaatgggagacctgcttttgtctccctacatttatcattttctaattcattcaacatacatttatttgaacatctgccacgtgccaggcactgttcaaagttctggggacacaacattgaacaatacctccaaagtttgtgttcttaatgagcttaacttatagtcagagaagatagacaataaagaaataaatatataatatttcaggcactgttaagtgcattgaaaaaaaatggtgggagcaatatttacatacagtgttcagggaaagcctcactgataaaatgaaatttgagcagcgtcctgaaggaagtaagagaacttgcattagagtatcagggacataattttaagtagagagaacagaaactgtaatggtctagagataggcacacatctagtccatttgagaagaacaaggaggtcagtgtggctgaggcaggattaacaggagacaatggtaacagatgaaggcagagaggttgcagagggtcaaatttcgtagggtcttgaaggccatggtgaaggctttggaatttactgagtgagatgaaaatccactggaggatctgaagcagagaacagtgatcagaattgcaatttgaaaaattactttagatgcaatgttgggaaaagactatatgagggtaaggttggaaacaggaaggctttgtatcaactctcatctgaattattgcaatggcttcttgcaataattcagatgagaaatgatgataatttagatgtggttggtagtcactgaggtgtagagaagaggctggggtgtgtgtgtgtgatttatagacttgattttattattttaatacccttttattattacagaagcagtgcatatgcagtgcagataatttgaaaatatagccaaataacattcaaaaaataaaaacatcacttttatagcatctgaagtgacactgtatcctctcttggcttgtaacctgctttccctggtcaattatcttcatcgttccatttcagtacattttcatcttattcaatactaagtccataatcaaccctgactattttttgaaatgatagccaagaggatccccacccaaatctcatcgtgaattcccatgtgttgtgggagggacctggtgggaggtaattgaatcatgggggcagatctttcctatgctgttcttgtgatagtgaataagtctcatgagaactgatggttttaaaaagaagagtttttggctgggcatggtggctcacacctgtaatcccagtgctttgggaggccaaggcgggcggatcataaggtcaggagttagagaccagtctggccaatatggtgaaaccccatctctactaaaaatactgtggacttttgagttaatgctgaaatgagttatgactttgggggactgttgggaaggcatgattggttttgaaatgtgaggacatgagatttgggaggggacagggggaatgatatggtttggctgtgtccctaccaaaatctcatctcatgtggtggcacatgcctgtagtaccagctacttggaaggctgaggcaggagaatcacttgaacccgggaggtggaggttgcagtgagccaagatcacgccactgactccagcctgcgtgacagagcaagactctgtctaaaaagaagaaaagaaaaaaaagagttttcctgcacaagctttctttctttgcctgctgccatccatgtaagacaagacttgctcctccttgccttctgccatgattttgaggcctccccagccatgtggaacagtaagtccataaaacctctttcctttgtaaatttcccagtctcaggtatatctttatcagcagtgtgagaacagactaatacagtaagttggtaccagtagagtggggtgctgctgaaaagatacccaaaaatgtggaagcgactttggaactgggtaacaggcagaggttggaacagtttggagggctcagaagacgacaggaaaatgtggaaagtttggaactctctagagacttgttgaatggctttgaccaaaaggctgataatgatatggacaatgaaatccaggctgaggtggtctcagatagagatgaggaacttgttgggaactggagcaaaggtaactcttgttatgttttagcaaagatactggtggcattttgctcctgtcctagagatttgtggaacttcgaatttgaaagagatgatttagggtatctaccattctggggcctggaggacggtggtcctcttctcacagctccactaggtggtaccccagcagggactctgtgtgtgtgctctgagcccacatttcccttctgcactgccctagcagaggttctccatgagggcccacccccgcagcaaacttctgcctaggcatccaggtgttttcatacatcttctgaaatctaggcggaagttcccaaaccccagttcttgacttctgtgcactcgcaggctcaacatcatgtggaagctgccaaggcttgggacttgtaccctatgaagccacagcctgagctctacattgacccctttcagccatggctgtagcggctgggacacaaggcaccgactccctaggctgcacacagcatggggatcctgggcccagcccatgaaacaactttttcctcttaggcctctgggccggtgatgggaggggctggtgtgaagacctctgacatgccctggagacattttccccattgtcttggggattaacattcggctcctcattacttatgcaaatttctgcagcctgcttgaatttctcctcagaaaatgggatttgcttttctctaacattatcaggctgcaaattttccaaacttttatgctctgcttcccttatgaaactgaatgcccttaatagcacccaagtcgcctcttgaatgctttgttgtttagaaattaatggaagtgcctggatgcccaggcagaagtttgctgcgggggtgggccttcatgtagaaactctgctagggcagtgcagaagggaaatgtgggctcagggcacccacacagagtccctactggggtaccacctagtggagctgtgagaagagggccaccgtcctccagaccccggaatggtagatccatcagaaacttgcaccagcatctggaaaagctacagaaaatgccagcccatgaaggcagacacaagggaggctgtaccctgcaaagccacaggggtggagctgcccaagaccatgggcacccacctcttgcatcagcatgactcagatgcaagacatggagtcaaaggagatcactttagagatttaagatttgactgccccgtagaatttcagacttgcatggggcctgtaggccctttgttttggccaatttctcccatttggaatggctgtatttacccaatgcctataccccattgtatctaggaagtaactaacttgcttttgactttacatgctcataggtggaagggacttgccttgtcttagatgagacattggactgtggacttttgagttaatgctgaaatgtgttatgactttgggggactgttgggaaggcatgattggttttgaaatgtgaggacacgagatttgggaggggatggggtggaatgatatggtttggctgtgtccctacccaaatctcatcttgaattcccatgttctgtgggagggacctgataggaggtaactgaatcatggcagtaggtccttcccttgctgttctcatgatagtgaataagtctcacaagatctgatggttttaaaaagaggagtttccctgcacaagctctctctctttgcctgtgccatccatgtgagatataacttgctcctccctgccttctgccatgattgtgaggcctccccagccatgtggaactgtgagtccattaaacttctttcttttgtaaattgcccagtctcaggtatgtctttattagcagtgtgaaaatggactaatacaggatcctttacagattagatgttaatgtaagaaaaaaagagttggaaaacttcaagatctgtgactgaataactgaaatagggaatggttttacttatttatttttttgagatcaagtctgactctgttgcccaggctggagtgcagtgaggccatctcagctcactgcaacctccgtctccccagttcaagcgattctcgtgcctcagcctcctgagtagctgggactgcaggtgtgcaccaccacgcctggctaatttttgtatttttaatagagatgaggttttgccatgttgcccaggctgatcttgaactctggggctcaaccaatccacctgcctcagcttccccaagtgctggggttacaggagtgagccaccatgcccggccaggaatggtttttgattgccatggagaaggctgagcaatcagcaggttttgggaaggggcaggaattaagagtctaattgtgtgcatgttaaggtagggagttgatatgtaaattttgacttcaggagagagatctgagaatatctccagatattcaactggaattatctgcagatagatagtacttaaaatcatgaggctaaacaatgtcgtcacagagtgagtataaatagaataaagaagaagttggagaactaatccctggagcactctaacctttaaagattagggggatgaagaaggactcgcaaagttgacaaagattggcagtaagtttagtagaaaagtgaagaaaagtggtgttagagaaaccaagtgagaacctgtatcaacgatggagtaatcacctctcaaatactactgagaattcaaataagatgagggctagtaatcagtaatgtaaagatcaataatgaccttgaaaatgtagttcttatgaaataatagagataaaagcttctttggagtgggttaaagaggagagaatggcaggaaaagatgcaaaggctgcaagcagggacaattattttaagacggtttctgtaaagataggggaggaaataatagcatgattgatgttgatgagattaatctagtggagagataaattgatgatgtaagggagaaaaggagaaattgctggagcaacattttttatgaagggagaagagatgggaatcaagtacaaaactggagaggttggccttaggagcacagacactctatttattgtaataagtgtgcaggcagagtatatgggtacaaatgccagtaaatgtgatgttgggagtctgtggaggttcattgcacagcatcagctaagagtgaaaatgggcattggagaatggaaaaaaggtgctcgagatttaaggaaaacacagaaaatctaagatagaggtccaggagaatgagaaagtcagtggactagggaaatagtctatggttgcaatgcagcaataagggcttacttgagctagaaagcaaggtgggaaagtgacaagtcatgcttgtcccttcttgttcctcaaacatggtaaactttttccattctcagggcctttgcattttctcttccctctgtctggaaacatcttctctcagagctccatcagctggcctgttatcatcatttaggtctcaactcctcaaagatgatttctatgaccaccacagctaatgtaacactctaccgtattactctatcatattattctctctaccatattattctattctatcttctgaacaacacaattgagattgccttatttagttttgtactaacttgtctcttgctctttccaatagaatataagctcctgctgtgctgcactccaatgtgtacaaaagtgtctggcatgtagtaggtgttccataaatatttgtgactgactgactctccttatgtttatattccacatttctctgtactacttgactgctcaacctccctctactcacctaaaaataaaatcatcctactttgccctctggatccccagtatcatgaaaaccaatcctccccaagtccttaacctctttaacacgaacttgcttcttccttctgccttgcttaaagttctctgatgagactaagatttcccctgcagctcataaggttgataggtgaggttgactttcttcctgctccccattgctccttcttgtccctgattcctctaccctcttgtaaacctctcttctctctatctcaccagagtaagagtttcaagacaccttgatttttcatcctctaactctcattgttggtgtcatcatctggtaaagtcaaatgtcacaagagcagagcaaaggaataaccaatgcattcatacctgtttcttagaacatgtggggagctactcatcccataatcccagagcctctccactgcagcaataaaatagtgtcgtgttttcttttgaaagctgcgggggctctgattttcatcctcatcataaatgtcaaaatcttccttcttcatttcaactgatatggtatcatcatagtcaatttcctcttgatctgactgaagagtagtacgagttatttcccgttgatggcgtttcaagactggtgggttttgagagcacagcctttcagtcctaccttgctttgcccaggtgacttctatttcgggcttattttgtccctcatttattgctgctattgcatgattgctttcacaagcgttcagggacaaaatggtatcctttttcttaaaagctgttttttctggtgacttctcttgggatttccactcttcttttggtatctgagtaccatagtggttatcccaagcaagaggatccaatagcttggagggagtctttgcagagctttctgttgctactctcagaaagggaacttttccaggtctgtttgcttcattccacttaatcgctccctctgttccctgaagaaggctcccttccacgagatccagatggccaggagacccattgctagtttccgtagggaataggtccttctgataaatgtgaacttttggaagcaattcaactttgccagatgttttgggcaagtctggtttcgggagaacagtgttctcaactttcttgtatgtgactgaatttgtggcacttgtccccagggagccaacctctctttgatcaccagtcatctccaaggttagaatggctaaagaaaggttattttttttggctccttgtaagaaatgactgctttcttggaccccagaatctttctttctataagatgctgctggaagatgagaagagttgtcttggaataggaccctggtcagatatataggtctaatagatggaaatgatgatacctttgcaatgggtaatggagatctatttgcttgagggatgctatgactcctcgtaaggcaatctgataagggagactgagtaatggcccctttctccttctcattgtagtctatctgtgtgagggtgctcggggtcaaatgtttcatgtttttggaccactgggttgaggtgtcatccacaattatccttttttcaagttctgtttcttctagtgggagtctgaattgtttcaaagctctcttactacgttgcgtgacaaaattctgctggcttgtattaggagatatccttgtggtgcatgcatatttctctacaatttgcttggtttgatttcccaagccttccaagttttcttcctcccctttttttgagaaatgagctgtgtgtttctttgttctatttgttgaatcatttaatgacctaaaatcttgaagtactggagcatatgccccgtcatatgaaccttctacattttgcctagtgctcagtaagaaaaggttcttcatgaaattcttagtgccagtcactgtatgtatctgaggcaaaactacattctcttggattaatgtttccttcttttctatttcttcctgaatttttttttcttgattgtgtgtattattttcatgtaaattatccaagttagtaagaaataggtttctgctgcttggaaaaaccatctctttgagtcctacgtcctttgtaaattcaccctttcctactaccactttgtttttctcagacaagaaattctgaccttccacagatttttctggtcctaaggatactaattgctttggactggggccttgcccagagttcagagagttctttccatgagtcctttgtatccaccttgctgattctggcaagaatagcatcttaaagaacgacatatctggattttgtgcatctggtggaatggggccctcttttttctgttggaccatttccatgttttttgatgaagtagttttatttgacatatgatttagcctcaaagctgtagcatttttgtccataagcattctgtcatgaatcaaaggtgtcacttttttaaactcagtgtcactttctaatatattttgccagactgatggactattctcaattaataatgatgggccatcaatgtgagtctttctattagttgctgaattattggaagttttgtttgtctttaacaaagagatgctaactttgaataaggcattatctttagtcaacaaagcaggtccatgagctcttttccctttaaataacctaccactctctgttgacgatacattttttccccatgaactttcttggctattcattaaacctgattctaacaactttgaatcattattttcttcactcaagctcagaggtccaccagactcagtaaggggagatgactttttgccaaatagagtggtatctaattgactatcataatgaactggcatacttgggggtcctaaggaacttgtattatcagtacctgctgccaaattgtctgatggaattgttgaaatcagattatttgatgtactagaaactttgaaatcaagtttcttcaactctgttgctgcagttgtccccagtttctcatttaatcttaattggaggcctgactcaggggtaaataccatgtccccactgtgatggagctgtggcctgaagtgtgtcatttcagacaggctgttattactgtctattgctccaggtgatggatcatcagaaaaagtctcatatttggcttcttggagatcagataaggatagcccatgtggagtaggactctgtcgcaagagcatcaacaaatcactagaggagacattttgtattttaggcataggtgttctgtgtgcaaaccaagggtcagtcttctctatgtcattttctggaattgtggtggcattaaattgcttttgcctagtgctagggtgtcttgaattctgggagaagcttcttggttcaatggcattgtttttactcagcaagtatgctgaaatatcttcataactgtcctcgtaataatcaccagtgttcttgtcacaactagaaaccttcagtaaggcggtcatgcctctgttccgaaagtctgagttgtggcaccccagaatccatagacctggagatgaggaagaataagactctggttactcataacacagattctaaaacgttctgttagaggttctctcccattcccagataaatgaaaaaatactagtcagtatcattatatcacaggtcattgggttaaatccctggaacatgtaatataaaagtggtttttgcattgctgctgttgtactatgcctgtttgtgaccataagaaaggactgtgataaaaatgaatagatattgggattaaaatagggaaatgtaattaatatacacaataatggagggtcttaatagtgacacagaactctctgaatatgacagtgatttaattcaggaaagtatttatattggctagatgttattgctatatcacatagtggcacaggttcctcttaaatccatcagattgcctggattcaaatcccagttctaccatttaccagctgtgtgactttgagaaagtcacttaaactttctgaacaataggtttctaattttcaaatgaggctaatagtatctaccccatcatataatacattgaaatcacataacacaatacctagcatccactgtcacccacttgcagaatatgtaagcacaaggaaggagcatttaggtctaggatccagctaatataaaattctaccatggtactagcaatattaatttctaccatgaacaagattagctgagtgaaggaatgcaacaagttataataggctaattacatggtggtaaagtagatgcataaacataagagacaagatacacctttaccaagctacccgttgggtacctcaatagccttgtcatttcacacagtcttttcagggaagatcttaactgcatccaccttcttctcaagggaagctgctcccaaaagccctgtgaatgcttacattctatgtgcagccaaattatcaatcaagtggcaaaggagaataaaaacatattctaacatataaagactcagaaaatctacctcaaatgtcaccattatcaggaagtgattatggaatgtttgccaccaaaataaaggagtatctcaaacaagagtaagacctggtatccaagaaccaggtacctatcctgagggagggtaaataaaagtcccaagttgataactgagcctcaggcctagagagaaccagctcagactggagcagggggatgcatgcctctaggaggtcaatctgtaagcaaaaaggaatacattatatgatggaactcttgaaaaaaagaggataattcaaaggcagacattataagaaaaacagggaaacaattagagattctcgtcaaactagttaccaaaatggacttttatttaccctcccctctgagaggggcctggtattaggaatggtgaccaagctggagtttagttttaatggcttgggttaaaattttgtaatgaaaatatctttttgtattgtatgtgtgactaatggtaaatttaaaacattataattaattcataaatttcaatccaagaacttagagttggttgtttgatgaaaaagtcaataaaataaataaccaaataaaaattaagaaatttcacatatacaaaatttgaagtaagaaaagagacataattacagacacaaagaaaatgaaaataattgtaattcccttggagacacctcagctgtcaatctcctcctccaacttctgacataggtataagctatctggccaagttggggtctagtcagcactacaaatatatagatcagtctcctgcctctgtgatcaaaccagggctttcactgaactaattaattctgtaagctattatccgatcttggaactagttactagctgttgagttgagaagggaattcgacatccattaagtagacagagagttaggctaagagcaagccacttatcctctcggctagcaaaccttgatcagaacatatttgtaccttgtttaaggacgagaaaacatgcaatctataaatatactacagaacagggagaaggaaacagaagtcaggaaacttagaggcaatacctacttctgaaagtaatccactgcagattctagaggaaaagtaagaacaaatatcttgccatactaaaacacaagaaggcacagcttccataatttaaaaccacaaagacatagcttctataatttaagactggaaagggcatacacaaggtgaaatggtaattcagctggatgaaatagaaaagaataattataagaaaacttaacacataacaagagatgatcagtttgtgtgtgtatgggttccaataaaaccttacaaaaacggacagagaccagactacccaagggccatagtttgcccactcctgatgtagatggtcacccactgtgcctttcatggggtttcaaaagatgaccagtttttaaggtagtgaagaaagggctggcctttcttcttgctcctttcagaaattgctgcaaataattaaagacagagtacaattaagctggaagatatctgaagccatgaaaccacaaaatagaagtatagttaatataaaacaggtatcaaaagataaaaagagtggatgctcatggctggcagatttcagaaaagtccaagaagacatacttcctcatatcttataccgccatatcttccccatttttaatatcaaagtctaattattcctcctacttcagcctcccaaagtgctgggattacaggcatgaaccactgtgcctggccttgtttctttcttctatcaaggtgcaagtattatactttgatatgaaaaacagtcagtcattcattataacaatgggatcagggtatacaagctagcatcggtggttttactggactcctttcaacacaagtctcaaaaggtaggaaagatgggaccagaagaaagaatcacattgacaagtcatttttgcactgtaagtctgttttgcaaggtggggaggggaggaaagaaattctgaaatgtaaacaactctgcagctttgatcttgatgggctggagagaagtaaaggctgaaaactcacacatacaatcaatacctttcataagagaattcctgctaatctaaaactcactcctaatgcctcattgatattaatatatctacataaactttctgcgaaaagtttatttagaacaaactcacctcaatgataaataataagcaaaaaggatcaagatactacaagataaaaggaagaaaggaacaacaaggccaggtgcagtggctcatactggtaatcccagcactttgggaagctgaggttggaggattgcttgagcttggagttcaagaccagcctgggcaacaaagcaagaccctgtctctacaaaaaataaaaaagttagcctggcatgatggtgcatgcctgtagtcccactacttgggaggctgaggtgggaggattgcttgagcccaggaggttgaggctgcagtgagccatgatcacaccacttactccaccctgggcaacagagtgagaccctgtctcacaaaaagagaaaggaacaacaaaaacgaataaaagaagagcagtaataaaaaaaatgttgccaaggagaagataaaacttgtaaccaaacatatcaccataatctaatgagatgaccacatctgaaaaaccaaagtctaatgtagaattagctataagaatttatagaagacgtatgggtcaatggaacagaatggagagttcagaaataaactctcacatttatggtcaattgattttcaacaagggtgtcaagatgacttaatgggaaaagaatcatattttcaacaaatggtgccgggacaactggatgtttacatgcaaaaaataaaaaagaggttagacctcttcttcacaccatacacaaaaatttattcaaactagatcatagacatatatgtaacagctacaactatcaaactcttagaagaaaatatggaagtaaatgtggccttgggctagacaaagccttcctagatgtgacatcaaaagcacaagtgacacaagaataaaaagataaattgtatgtcatctatgagttcatcaattaactcaacaacccaggaaacaattactgaagtaaaaataggtcaataaatgtcaacaaaactgaacaactagaaggaaaaatagttagaaaacaaactagaacagcatattcaagagctgtgtgacaaaattgaacagtataatatatgtaaatgcaataccagaagaagagaaagaattagaagcaatatttgaagacacagatgataaatatttttcaaaattaatgataccaaattacagattgaataagcctagagaatgccaaagtaacacacacacacacacacacacacacacacacacacacacacaaaaatcaaagtaaagagcttgaagccatccagatttttttaaaaagatacattatgtacagttgaatgcaaatgggaattacaacaaacttattgtgaaaaactatgcaagtagaaacaatggagcggcatttttaaagtgctgagggaaaaaccaataaaacaaaatgtaataaaacaaaaacaacaaccacaaacccagaattctatacacagtgaagatataattcaaaaacagaaataaagacttttcagagaagcaaaaactgacaaaattaattaaccaacagacttgcactacagaaaatgttaaaaaagacacactgtaaatataaggatagagataggttgaaaagaaaagaatgggaaatatataccacacaaacattaagcaaaataaatatgatagtgcaggtgtataaattttagacaatgcagacgtttaaggcaacaagtactacttcagacaaaaaggacatttcacaaagatgaaagaattgatttaataagaatacaaccttaaagttgtaagcacctgattttatattgcctcatttattttgaaacattcttactaacaaatacaaaaatcaaaataacaaactcaacaatcacagagatgtcacagtttcctccatgtctgtaagaaacagataaaatatcaggaagtttataaggattttaaaaacatgataaagcaacttgacataataggcaaatatatgacactctacccaataacagcaaagacatatttgtttcaaatgcagtgggccattaatcaaattaaattattcactgggcatatagcaagtctcaacaaatttcaaatgattgaaataatatagagtatgttatgtgatcacagtaaaacaaataaatcagcaacagagagagagccagaaaatcgccatatattgggaaattaagtaaaacactgtaaaataactatgaataaaacaagaaataacgtaaaatttataaaatattttaaactcaatgataataaaaatatgactcatcaaaatttgtgatatggggttaaagcagtatataaagggaaatttatgctttgtatgaacttttaaaaagtaagaaatgttgaaaatcaatgaaccaagttttaatctcaagaagtcaagaagaaaaagaaaactgaatccagagaaagtattggaataataacaaaagaccagaaataaatgaaatgcaaagcaaaataaaaataaaaattcaacatagaaaataaacaaaacaaaaaaatttttttaattccatgacctgatgaacaaagcaaaaatttgatcctatggtaggattagtaaatttgatgaacctataacaaaggcgacaaactttttttttttattatactttaagttttagggtacatgtgcactagggggaggggcgagggatatcattgggagatatacctaatgctagatgacgagttagtgggtgcaggcgataaacttaaaatagataaaatataaataacaatatcaggtatgaaaacggagacatcagtacagacattataaggatgataaaagaacattacaaataacttacttcaagtaaattaaacaacttagatgaaagggacatatttctagaaaaacacaattgacaaaaactgataccataaaaaatattataatagcattaaataccaaagaatacactttacaaaaatgtgcaagacctgtacactaaaattttacaaaaacattgccaagagaaaatttaaaagatgtaaataaataactaaaccatgctcatggacaggaatactcaatattgtcaagaggtatgctcccccaaattgatctgcagaatcaatgtaatccctatcaaaacctcagaagatatttttattgataaaattgacaagatgattctaaaatttatataaaaatcaaagagagcaaagttggaggaattatactaacaaatattaaaacttactataagatagtatgttactggtacaaagatagaccaataagtcaatggaatataagagatcaggggttggcaaactttttctgtaaaaagcaacatagtaaatattttaggtttgtagacacatatggtccatgatacatatccttatttgtttttttgctttttttttgttttgtgtgacaattctttaaaaatgtaaaaaaattcttagctcaatgccatataaaaacaagctgcaaatttggcttgtggatcataacctacccctgaaatagagtacagaaacaaagctacagtgatacagtcatcagattcatggcaaagacaacagtgcaattcagtgaggaaattatttttttccaacaattggtgctagagcaattaaatatccatatggaaaaatgaacttttatctgcatcactccatcaaaattaattaaaaatgaatcataaacttaattgtgaacaacacagcaatcagacttctagaagaaaatatttaaaatatgtagaaagaaaatatagaaggatggcatcatgttcttaggataggcaaaaatttctgaaacagaatacaaaaggcattaaccataaaaaactgaaaaataagaattaattaaatgtaagaacttctattaaccataatgcacccttaaaggagtgaaaagacaaaccacagactgggagaaaacattcacaatatgtaaatccaaccaaggacttgtatctaggcaaaataaagacccattctgaccaaaaactgacagagaactttttactagccaacacacactgaaggaagttccaaagaagtttcttcagacaaaaagaaaatgatcatagatggaagcaagaaatgcagaaaagaatgaaagaaatgaaaggtgtaaatatatatatatatataaatgatattgattatataaaacaataataatgtcttatggggtttaaaatatatgtagaattcaaataaatgacaagagcacaaaaggtaggagtgagaaaatgaagtcacgttgtttgaaggtctttgcattgggagccaagatggccgaataggaacagctccagtctacagctcccagcataagtgatgcagaagacgggtgatttctgcatttccaactgaggtaccgggttcatcttactggggagtgccggacagtgggtgcaggacagtgggtgcagtgcactgtgcgtgagccgaagcagggcgaggcatcgcctcacccaggaagcacaaggggtcagggaattccctttcctagtcaaagaaaggggtgacagatggcacctggaaaatcgggtcactcccaccctaatactgcgctcttccaacgggcttaacaaacggcacaccaggagattatatcctgcacctggctcagagggtcctacgcccatggagccttgctcattgctagcacagcagtctgagatcaaactgcaaggtggcagcaaggctgggggatgggtgcccgccattgctcaggcttgagtaggtaaacaaagcggccgggaagctcgaactgggtggagccccccacagctcaaggaggcctgcctgcctctgtaggctccacctctgcgggcagggcacagacaaacaaaagacagcaataacctctgcagacttaaatgtccctgtctgacagctttgaagagagtagtggttctcccagcacgcagcttgagatctgagaacgggcagactgcctcctcaagtgggtccctgaatcctgagtagcctaactgggaggcaccccccagtaggggcagactgacacctcacatggccagctactcctctgagacaaaacttccagaggaatgatcaggcagcagcatttgcagttcaccaatatctgctgttctgcagcctctgctgctgatacccaggcaaacagggtctggagtggacctccagcaaactccaacagacctgcagctgagggtcctgactgttagaaggaaaactaacaaacagaaaggacatccacaccgaaaacccatctgtacgtcaccatcatcaaagaccaaaggtagataaaaccacaaagatggggaaaaaacagagcagaaaaaccaaaaactctaagaatcagagcacctcccctcctccaaaggaatgcagctcctcaccagcaatggaacaaagctggatggagaatgactttgatgagttgagagaggaaggcttcagaagatcaaactactccgagctaaaggaagaagttcgaaccaatggcaaagaagttataaactttgaaaaaaaattagacgaatggacaactagaataaccaatgcagagaagtggttaaaggacctgatggagctgaaaaccacggcacgagaactatgtgatgaatgcacaagcctcagtaaccaatgcgatcaactggaagaaagggtatcagcaatggaagatgaaatgaataaaatgaagtgtgaagataagtttagagaaaaaagaataaaaagaaacaaacgaagcctccaagaaatacgggactatgtgaaaagaccaaatctacaactgattggtgtacctgaaagtgatggggagaatggaaccaagttggaaaacactctgcagggtattatccaagagaacttgccaaatctagcaaggcaggccaacattcaaattcaggaaatacagagaatgccacaaagatactccttgagaagagcaactccaagacatataattgtcagattcaccaaagttgaaatgaaggaaaaaatgttaaggacagccagacagaaaggtcgggttacccacaaagggaagcccatcagactaacagctgatctttcggcagaaactctacaagccagaagagagtgggggccaacattcaacattcttaaagaaaagaattttcaacccagaatttcatatccagccaaactaagcttcataagtgaaggagaaataaaatcctttacagacaagcaaatgctgagagattttgtcaccaccaggcctgacctaagagagcttctgaaggaagcactaaacatggaaaggagcaaccagtaccagccactgcaaaatcatgccaaattgtaaagaccatcaatgctaggaagaaactgaatcaactaacgagcaaaataaccagctaacatcaaaatgacaagatcaaattcacacataacaatattaactttaaatgtaaatggactaaatgctccaattaaaagacacagactggcaaattggataaagagtcaagacccatcagtgtgctgtattcaggaaacccatctcacgtgcagaaacacacatagcctcaaaataaaaggatggaggaagatctaccaagcaagtggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatactcaggaattgaactcagctctgcaccaagcggacctaatagacatccacagaactctccaccccaaatcaacagaatatacatttttttcagcaccacaccacacctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagatggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacagaattgatagaccgctagcaagactaataaagaagaaaagagagaagaatcaaatagatgcaataaaaaatgataaaggggatatcaccaccaatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccgaaaagagtccaggaccagatggattcacagccaaattctaccagaggtagaaggaggaattggtaccattccttctgaaactattccaatcaatagaaaaagagggaatcctcctgaactcattttatgaggccagcatcatcctgataccaaagccgggcagagacaaaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaatttggtattgatgggacgtatctcaaaataataagagctatctatggcaaacccacagccaatatcatactgaatgggcaaaaactggaagcattccctttgaaaactggcacaagacagggatgccttctctcacctttcctattcaacatagtgttggaagttctggccagggcaattaggcaggagaaggaaataaagtgtattcaattaggaaaagaggaagtcaaattgtccctgtttgcagatgtcaggattgtatatctagaaaaccccattgtctcagcccaaaatctccttaagctgataagcaacttcagcaaagcctcaggatacaaaatcaatgtacaaaaatcacaagcattcttatacaccaataacaggcaaacagagagccaaatcataagcgaactcccattcacaattgcttcaaagagaataaaatacctaggaatacaacttacaacggatgtgaaggacctcttcaaggagaactacaaaccactgctcaaggaaataaaagaggatacaaacaaatggaagactattccatgctcatgggtaggaagaatcaatatcatgaaaatggccatactgcccaatgtaatttatagattcaatgccatccccatcaagctaccaatgactttcttcacagaattggaaaaaactactttaaagttcatatgaaaccaaaaaagagcccgcatcgccaagtcaatcctaagcctaatgaacaaagctggaggcatcacgctccctgacttcaaactatgctacaaggctacagtaaccaaaacagcatggtactggtaccaaaacagagatatagaccaatggaacagaacagagccctcagaaataacgccacgcatctacaactacctgatctttgacaagcctgagaaaaataagcagtggggaaaggattccctatttaataaatggtgctgggaaaactggctagccatatgtagaaagctgaaactggaacccttccttacaccttatactaaaattaattcaagatggattaaagacttaaacgttagacctaaaaccataaaaaccctagaagaaaacctaggcaataccattcaggacataggcatgtgcaaggacttcatgtctaaaacaccaaaagcaatggcaacaaaagccaaaattgacaaatgggaactaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttcacaaaagaagacatttatgcagccaaaaaacacatgaaaaaatgctcaccatcactggccatcagagaaatgcaaatcaaaaccacagtgagataccatctcacaccagttagaatggcgatcattaaaaagtcaggaaacaacaggtgctggagaggatgtggagaaataggaacacttttacaatgttggtgggactgtaaactagttcaaccattgtggaagtcagtgtggcgattcctcagggatctagaactagaaataccatttgacccagccatcccattactgggtatatacccaaaggactataaatcatgctgctatagagacacatgcacacgtatgtttatagcggcagtattcacaatagcaaagacttggaaccaacccaaatgtccaacaatgatagactggagtaagaaaatgtggcacatatacaccatggaatactatgccgccataaaaatgatgagttcatgtcctttgtagggacatggatgaaattggaaatcatcattctcagtaaacgatcgcaagaacaaaaaaccaaacactgcatattctcactcataggtgggaattgaacaatgagaacacatggacacaggaaggggaacatcacactctggggactgttgtggggtgggggaaggggagagggatagcattaggcgatatacctaatgctaaatgacgagttaatgggtacagcacaccagcatggcacatgtatacatatgtaactaacctgcacattgtgcacatgtaccctaaaacttaatgtataataataaaaaaaaagaactaataccagctcttcacaaactatcccaaaaatcaagggggaaaaatacttccaaactgattccacaaggccagtattaccctgaaaccaaaccagacaaagacacacacatacacaaaaagaaactacaggccaatatctctgatgaacattgatgcaaaaatcctcaacgaactactagcaaaccaaattcaacaacacagtaaaagatcattcatcatgatcaagggggattcatcccagggatgcaaggatggttcaacatatggaaatgaatcaatgtgatacatcatatcaacagaatgaaggacaaaaacaaatgatcatttcaattgatgccaaaaagattaaattcaacatcccttcatgagaaaactctaaacaaactgggtatagaaagcttacctcaaaacaataaatgccatatatgacaaactacggctaatatcataccaaatgtggaaaaccaaaagcctttcctttaagatctgaaacaagataaggatgcccactttcaccaattctataaaatgtagtcctggaagtccaagccagaacaagtaagcaagagaaagaaataaagggtacccaaattggaaaggaagaagtcaaattctccttgtttatagatgacataatcttatatttcacaaaaaactaaagactccatcaaaaaactattagaactgataaacaaattcagtaaagttgcaggatacaaaaccaacatgcaaaaatcagtagcatttctatataccaagagctaacaacctaaaaagaaattttttaaaaatcatttacaatagctataataaaaataaatatattggaataaattaaaccaaagagctgagatatctctataatgaaaactaaaatactgataaagggaattgaagaacacacaaaaaactgaaaaggtatctatcccattttaatgggctggaaaaactaatattgttaaaatatcaatgctaccagatttaatgtaatacctatccaaatgccagtgaagtttttcacagaaatagaaaaaagaatcttaaaatttgtgtggaaccacaaaagactccaaacagctaaataatctggagcaaaatgaacaaagctggaggcatgacactacttgacttgaaactatactacaaagctgtagtaacaaaaacagcacggtactggcataaaaccagaaatatatgccagtggaacacgacagaaaacccagaaataaatccacacatttatagccaactcacctttgacaaagtgccaagaacacgcactggtgaaagaatagtctcttcaataaatggtgtgggaaaactggatatccacatgcagaagaatgaaactatacccctatctctcactatatacaaaaatcaaatcaaaatggattagagactaaaatatacaacctgaaagtatgaaactactggaagaaaacattgggggaatgcgccaggacattggtctgggaaagattttgcaggtaagacctcaaaagcacaggggactaaagcaaaagtagacaaatgggattatatcaagccataaagcttctggacagcaaaggaaacaattaacaaagtgaagagacaatttataggatgggatgaaatatttgcaaactatacaactgagagggcattaataaccagaatatataagaaactctagtcaatagcaaaaaaaacaaagaaccctattaaaaatggacaaagatctgaatagacatttctcaaaagaagacattcaggctgggcacggtggctcacgcctgtaatcccagcactttgggaggccgaggcgggtggatcacgaggtcaggaaatcgagaccatcctggctaacacggtgaaaccctgtctctactaaaaatacaaaaaattagctgggtgtggtggcgggcacctgtagtcccagctactcgggaggctgaggcaggagaatggcgtgaacccgggtggcggagcttgcagtgagccgagatcgtgccaccgcactccagcctgggctacagagcgagactccgtctgaaaaaaaaaaaaaaaaaaaaaaaaagaagacatacaaatggccaacaagtatatgaaaaactgctcaacatcactaattaccagagaaatgcaaaccaaaagcacaatgagatatttcactccagttaaatggcttttatcaaaaagacaaaataattaaaaaatgctggtgaggatgtggcaaaaggggaatgcttgtacactgttggtgggagtgtaaataagtacaaatactgtggaaaagagtaaggaggttcctcaaaaaactaaaaatagaactactacgtgatccttcaaactgtttattagttgcaagggtgaaaataataactactcagaggagaaactagatccctgtacctcaaggaagaaaatgctataaatgacagcatgtgagctagtgggcaaaagagcatacgaatggctagtgaagcattcacagctgttggtacaagaaaaatataataactaacctgggttttccatcgacatgaagacagtttctcctgagaatgggaatagggtgagtgtgtcttcatagaccattttgtgtttgaaggtatatccagagaagaagacagaaaggaagtcagtctgtgctccaatgcttagaatgtaccagtatgccacctcatgcaaacaaactgacaactgcaaactatcaaaaacatagccattgatgcctgcaaaaacaatggggaaaagagatttagacacatcacagatttagtattttggattgtgattgtcatgatacaattaggaattattatatgttatgcccattatcttattcccaggaagagatattatatcttccaaaaaagtagattgttaataatcagttgggccccaatcccaatgtgaggagacagtcataaaccatcatgataaagattaatttggatgttatatggggggcattttgatgagtagcaagatgtttgcatggtcttaaactacacagaggagaaaccagaaaaaaacctttgggtgcttaaagttaccatctgatgaaggtccagattcaaggaaatgaaagaagcaggacaagtagttacttgtactagatccctgtacttcaaagaagaaaatgctataaatgacagcattggttgatacaactggaataccagttgtaaattatggaaatgtgctttatcaatttgaagtgtctgttatgtaaaagatatctttattcacaggaaatgtgtactaaagtattgagaggtaaagggatgtgatgtctgcaactaattttcaaatagaaaataagtaacagaagtgtgtatataaagaaaagaaaatgaaaaacaaaattgcaaaatgttaaacatttgtgaatctgggtaaagggtgtgtgcaagttccatgtattattcttgtaacttttctgtacattttaaattatttcaaactaaagagctaagcaaaagtaacattggccttagtctatgaagggaattgtttctgaaagcctcttccacacatccattcatccatccattcaataaacacttgtctactctgttactaggtactgtgtaagatggttgcccacaaaccactaagcaatacttagacattggcttagtataactaattaataattgaagtttttttcctatacaacattgagatattataaagctattataattaaaaatgcagtcttaatgcagaatagataaatatatcaaacaaaatatggagtccagaaactgacaagatgtaagcggaaacttaatatataataagttgaaacttaatatataataaaggcagcatctccaaccagtacaggaaaaaaatcagctagttggtaaatgataatagaaaatatgactatccacttggaaaaaatagattccacttcatttcacataactaacaaaagtaaagtccttttaaattaatctgaattttgcctaagggtacctttgcacttgagtccttgcacaacaaagttgcagcctggcttagttgatgaactaactgaaagcctaatttaggaatatgcttttataacaaacagctcagtctcagccgattatagcagctgaacttccatcaattgcaggcgactaacagcttcaaataaggcaaaaatgcccaactgtaatcaattaagctgtctctaaacctcacttccaatttctatccatactatgttgctggctgctgttctgtatttggttctgagggctatctgattctagaatcatgtataaaagccaattacaatctttaaaatacatttgttgtatttttgccttttgacactccacatggattaaatagttacatgtcttttgtgaaatatgtacacactacttttgggtgctgtactagtggctagggttgccataacaatataccacagactgggaggtgtaaataacaggaatgtgttttctcacagttttgaacactaaaattccaagatcaaggtattggcaggtttggtttttactgacacctctccttggcttggtctttcctctgtgaatatgcatccctggtgtctctgtgtgtacacatttcctcttctttttttttttcaaatggagtctcggtctgtctgccagtctggagtgcagtggcgtgatctctgctcactgcaacctccacctcctgggttcaagcaatcttctgcctcagtctcccgagtagctgggactacaggagctcgccaccatgtccagctaatttttgtattttcagtagagatggggtttcaccatgttggccaggatggtctcgatctcttgacctcgtgatccgcccgccttggcctcccaaaatgctgggattacaggcgtgagccactgtgcctggcccacatttcctcttcttataaggacactagtcatattggattagggcccattgtaacaacctcattttaacttaataaaccccttaaagaccctatctccaaatacagtcacattctgaaatactagtgttagggcttcagcatattaattctaggggacatgattcaggacataacaggtgtatactaggagtggatttcctgagtcaatagggtatgccgatgtttggctttcgatgtttggatttcctgaccagaaatttatgagagttctcattactctacatctttaccaatacttggtatggacagcctttttaattttagccattctggtgtatctcattggtggttttgtttttttaatatcatcctatccagtttattccttaacttgcataatggttatctgaaatcactggaatgtaagcttcctcaggcttaattactagaatggctgattcttctctatccaatctttttaaatttattttttaattgacagggaaaaatagaatatattatgatgtacatcacaatgtttatatatgtatatattggaatgggtaatttattaactgtagtcaccatagtgtacaatagatgtctttaatttatttctcttgtctaactggaattgtgtggcaaagtctttatctctctgcatttctgaaggaaacattttctaggtaaagttttcccagtactcggaatatatcatcccaccctcttctgacctgtaaagtttctgccttattggaatttccttgtatgtggtttgcttcttttttgttgttgctttcaggattctctctttgtctttgatatttgacagtttgattgtaacgtgtcttcatatagtcttgtttgaatctaatctgactagagatctttgagcttcttgtacgtggatatttacatctttctccagatttggaaagtttttgctatcatttctttaaatacactttcttccattttgtctcactcttcttctagttacccatatcagaaatttggtaatcatctttgaatcctcttagtcctttaccaaacatagctaattatttacaaaatcatgtgccttctatcttctaaacaaatcctgtacatgttccttcctcttcattcctactgcaatttccctatcatttgtaggatccatctacgaaataaatcataaatcctacaattttttaaaacacaaaattataaaacaaacatctaggtcatgaaatacaatattgctgctatccccacaaaacacatgtgtttattctcaaatgaactctttctaagaggtagccactatcttgtcttttattataatcatgtccttactaacctttatacttttcttcctctgtatccctaaactatataagttaattttgcccatttttgaactttatgtaaataatataatactgtatatattcttttgacacttaccattttactaaaaattgtctttgtgatacttattcatattgttgtgtatagctttatttttgtgaatcttcattgtcacatggtatttcattgtatgaaaatagattatcaattttactgctaatggaaataggagtgatttatggtttgggtctctctcctcctggtccttttttttcttcttttcttatccctctgtcttagcatctttctccctggactcttcctctgaagatccttcccctgtgtctcttggtctctgcctttgtgtctctccctgtgctttctcagactctttttctcaattccaatctcttctttctcaattccagactcttatctccaccaaaagctatattagaaatcccagaggaaaaaaaatatatatcatcttcagtgaaattgttttctggctctgcttatgtcactatatctctctagttttcatcaccgtctccaagaaaatgagacagtttaactgtccagatactgtggcaagtgcacatcctacttggaaaaagatgtggtgggaaagggagaaattatgaatagaaaaaaatagaagaacaaatatctagtaaatagcacaataaggaaattataaaatacaatattctatcaggctgaaggaattctaaaccaaagccatgaggctggagagaagagggagaaaagaaaaagctctgtgccactagaattaaatactaagcattagactcttgcacaaatgtgaaatctgaatccttcagaaggaaagcaataccctgaactatgtaaaaaataaaaatgcaactcaaaggactaaacaaccttaaaatttttagaataatggatagtaaaggactttaactctggagaataatatatcactattactagaaattcaagctaaatatgaggctcaacccaaagttaaagggctaaagctttgagaggaggggcatagaattgtaacatatgccacattctggtaggtgagtataactcacattataacttttcaaggttcccatgcatttcgttcaggattttttttttttttttttgaaacggagtctcactctgtcgccggcctggagtgcagtggcacgatcttggctcactgcagtctccgccttccgggttcacgccattctcctgcctcagcctcctgagtagctgggactacaggcggccgccaccatgcccggctaattttttgtatttttagtagagacggggtttcactatgttagccaggatggtctcgatctcctgacctcgtgatccgcctgcctcggcctcccaaagtgctgggattacaggcgtgagccactgtgcccggcctgttcaggatttttagttgcatccagtgggacacacagggaaatgtggctcactccatcttaaacatcttaataatcagaatttcaaaaggcatatattggttttgaaaagactatactacttatccactaatatagcatgagaacactcttttatccacaagcccactagtaattataattttggcagtttgatgggtataaagtgctatcctattgttattctatttcgcatttccctgtaggatagtgcaattggaattttttaccatatttttgaccattcagatttgtggtatatataaatatatacacatgtgtatgtatgcaatgggctgaattgtgttcccccatcccaaatttataccttgcagtcctaaaccccagtacctcagcatgtgactatacctggagatagtgtttttaaataggtagttagttaaaataaggtcattacggtgggccctagcccaacaatactggtatctttattagaagaggagattaggacaaagatatataaaggagaaaccatgtgaagacaagggagaaagccatctacaagacaaggagagaagcctcagaagaaaccaacgttgcccacatcctgatctcaagcctccagagttgtaagacaatagatatctgctggttaagccacccagtctgcagtactttgttatggcagcactagaagactaatacaatgtatgtatgtgtttatatatgattatataattatagagaaaatatgtcttaaaatatgttacctgggcatggaatggttggtgaaaagatgtaatatagaaggagatagggaattaaaagggagagggaaatcaagtaaatattgaaaggaaaaaatggtgactggatttttaaaatatgggttatatgatcacgtgtgtttgagtaaaaattatacatttataggtaacataattgttaaatttatgtgcacatacaattcattcattatctggacatcactttgattacatcaatttttctttattcaccacccactggacttaagtgctgctttactcactgtgcatgatgttggaggcttggaactctggatcctcaagctgcactccagctggattggggagaaagcgttgtatattctctgtgaggtaccagcttcggttctcatcaaatacagaaaacaggatgacattcctcttgtctgacattatctgttaattacatatattgaaaggggtaaagaaatgctactgatgttgtcaggtaggagctagcagtctatgatgaaagcgatggcatgcatgtgatatatctaatccattggtttaattccatttcctcttaggcatgtaccagggcttgggagttgagggtgggtgctatgagcagtgagtatatgcttacaacaaatgtgtccccaggacaagagggtgactgatcccactgaacttagttttttctgcacccaaggccatatgctagctgatttatttggtacagtctgtagccttattctcttcatgttcagattagaagatttaactccttaaagaaccaagtggttattcagtgcctttcttaagttagttaagtcaaatgagatactgactttcctaaacttccatctagcaactgaccttccacaaggctataaaaaattaaaaatagaaaaacagaaatcaaataagaaagataaggtgaaccacaaaaatgtcaaacaacactaataccttaaattttctgtttaaaacattcaaatttttttcagaagagcattttgtatatgaaccagatttatgaattagtcgcttgctaattggatctgctaagatttcatatgtaaacctcactaatatgtataaacctcattttttataacctatagctatataaaccaaaatactgaagagaggagattggagaatatagaataatatttcagttctcttcccaaaagtgacgaaaaaactatagttaggaaaaatcggtcaggacaagtacttggcaaaatttatacttctctgagtttatgtgccatgtgttttattggcaccaaagttcatatactttactctctaaacatatgaaatgttttcagactagtagggatcttatgtatcataaatataatcaaatggacatgtagtcaagcctcagcaatatggcactgagttattctggggccgagcaatgagtttttgtgaagaactaagcttttcttgttcagagaatttagctttattttttaaagcagtagaaatggtccaaattctagccatattttgaaatattttatatctttccctatgttttgcccaaaagtatttattaagcttttttttttttttttttttttttttttgagacagggtgtcgctttgtcatccaggctcactgcagcctcgacctcctgggctcaagctatcttcccacctcagcctcctgagtaggtgggactacaggcacacaccaccatgcccagctaattttttttttttttttttttttttgtagacaaggtcttactattttgcccaggatggtcttgaaatcctgagctcaagcaatcctcctgtctcggcctcccaaagtgctgagattacaggcgtgagccaccgcacgtagcctattaagctcttactaagtgagatgcactgtgctatattgtgggaactagcccccaatatttcaacataggttcttttctattttacctaagtgtcggccggtctgggaaataaagagaaagagtacaaaagagagaaattttacagctgggtctccaggggtgacatcacatgtcggcaggttctgtgatgcccccaagccgcaaaaccagcaagtttttattagtgattttcaaaggggagggagtgtacgaatagggtgtgggtcacaaagatcacatgattcaaaggcaataaaatatcacaaggcaaatagggacagagcaagatcacaaggtagggcgaaattagaattactaatgaggttccatgtcctgctgtgcatgcattgtcattgataaacatcttaacaggaaacagggttcaagagcagagaactggtctgactagaattcaccaggctggaatttcctaatcctagcaagcctgggggcactgcaggagaccagggcatattttatcccttatcttcaactgcataagataaacactcccagagcggccattttagaggcctccccctgggaatgcattcttttcccagggctgttccttgctgagaaaaagaattcagtgatatttctcctattcgcttttgcaagaagagaaatatgactctgttctgcctggccctgcaggcagtcagactttatggttatctcccttgttccctggaaatcgctgttatcctgttcttttcaaggtgcccagatttcatattgttcaaacacacaagctttacaaacaatttgtgcagataacgcaatcatcacagggtcttgaggcaacatacatcctcagcttatgaagatgacaggattaagagattaaagtaaagacaggcataggaaattataagagtattggttggggaagtgataaatgtccatgaaatcttcacaatttatgttcagagatcgcagtaaagacaggcgtaagaaattataaaagtattaatttggggaactaataaatgtccacgaaatcttcacaatttatgttcttctgccgtggcttcagccagtccctctgttcggggtccctgacttcctgcaacagtgctacatgctgcagacatgttaattttgaggtacttttgagtcacccataatgagatgtccatggaagaaatctaggctgtagatataaatctgtgggtcatctgaaaataggtggtaattggacatataaaaatggggaggatcagctagagagagctaaatcccagactgggaatgagtactataggaaaaatctagggcctacattctatggcctatccatccagcaggcacgtttactacgtgaaactcaaatttagtaaaagctaagctcatttcttttactgacctatattgcaaaccattatattttcttcaggttataaggggacatacactgagaatgaaacccagcacttggaaaggcaagaactcacctggtttcctctttgatctacagattctttgtagcagatgaggagagggccaatgagtcctgaagctagatctctctccatattaacgaaactagagtaatagcgggtcaggcaccgaggatctgatttagttggcccatcttctacagtcactgtccatttatatttgaatatttctcctggcagaattggaaaatccttcaaatgttttacacctacccacaagcaaaaccataaatagctcaattagagtacaacaagccacatattgataatcatgttgttgttgcaagggttctacaaatctgtatgtacatatgaagtttctgagcaagtggaagctaaagtcgcacctattataattttaagattcaaacaatttttttaaaaagtaaaaagctgtaattgattatccggttgactgtgaaagtgtcaggcctgaatatatgccaaagagcttggcattggagttttaaggtgtagtctctgacttctgtgaggaaagggagcaagaactgagatctgccctcagggtaatgggtcctcaggacaagaactgattttagtaattaagtctcattctgggtatgtttcatacctgaagatacaatctaaatcaaaattttaattttatattcattctaagctcttcctcacctcagtaagttatgcctgacctatggttagaggatccatagaaagggaatggtgttgaggtgaggagttcgagaccagcctggtcaacatggtgaaacgccatctctactaaaaatacaaaaattagccaggtgtggtggcaggcacttgtaatcccagctacttgggaggctgaggcatgagaattgcttgaacctgggaggcagaggttgagccgatatcatgccaatgcactccagcctgggggatagagcgagactctgtctccaaaaaaaaaaaaaaaagaaagaaagaaagaaagggaatggtgtagtatgttctttcaatatttctgagccttctcttcccttttccaggagctgggggtgagggagggtaggtaatagaagaaagggcaaacagactcttgtttaacaggtcctgctgctctatctttgacaacactatttggtcatcaatgttctctgtgtgggaggtgcccaaatgctggtcttttcataggacacatgtatggtttctttagagttaccatggggacctcagcattacatagttccatgacatgagagatgtttctttcagctatccttctgcaactctcctctccccatcagctcttcttacttccagtgatatatccaagactctattggttctgctatcccctcagcctgcctaactgccttcttgggtagaatatcttcaaaagggataaagcccagctactttcaacagtattcacttgttacagaataaactcatgtcaaacagcaggaaggtaaactgctccactcttgccctctcttcttgcccactattatgggcattacagccttcaaaattctccatggaaaagcaggttaccagtaactatccacgtatgcctccaaatttcgggacacacattcaaaatctccccagaactctgtcactatgccattcttccataaagaaatgcaaataaagaattcttatcggcaataatgaatattagaaaacaggggaaggaattttttttgagatgcagtcttgctctgttgcccaggctggagtgcagtggggtgatcttggctcactgcaaccttcacctcccagtttcaagcaattctcctgcctcagcctcctgagtagctgggattacaggcacacgccacaatgcccggctattttttttgtatttttagtagagatgggttttcaccatgttggccaagctggtcttgaactcctgacctcaagtgatctgcccgcctcggcctcccaaagtgctgggattacaggcgtgagccaccgcacccagcgggaaaatttttataaccagtctgtctgcccatcatgtgatactgaaggattcagaaagttcaccctctatgtaccacatatttagaagttacttgagaatatacttccagaaaaacaaaagaagaaatcaaaaaatagaaatgtacaagggaaaagtagttaatgctattcactacaagaatgtctttaagaagaaaaagatttggttccagcactttgggaggctgaggcaggcagatcgcttgagctcaggagttcgacaccagtctgggcaacaagttaacaccccatttctacaaaaaataaaaataataaaaaaaattagctgggcatggtagtgtgcgtctgtggtcccaactactcaggaggctgaagtgggaggatagcctgagcctgggaggcagaggttgcagtgagccaagatcgtgccactgtactccagcctgggtgacagagcgagacgctgtctcaaaaaaaaaataaaagatttggatagcaagcaatacatagaatgattaagaagctgaaaggcctaagaaatagggttgaagaagcctacatttcttttccgaataaaagaaaacaaagtcttacttcaggatacacctttgtgttgggaacattccaaatcctctcatctagctatttgaaaatagatgtcattgttgactacagtcaccctacagtgctatagaacattaggacttatgcctcctatctagctggaattttgcatccattaaccaacgtctccctatttccccctccccttcccctctttagcctctagtaaccactattttatctctacttctatgagatcaacttttttccttccacatattattttatcttaatagtaaaatcacttgagctgtagaaaagagagcaatcatagcatattacccagttctgcagttaacatttatgaaaagaaacttgctaaaatactaaaataatacaaatgctgttttttaattttttaagctttagagaaaatatatagacaaagcaaggaagagttatttcaaattacagcacaaaatgtaaatgttatcaagtttagttttgtaaaagtaaaggaatggctagcagcagtagagaaaagaaaggtttggggaaaggaaaagtgaggggtacagtttttaatatccttaatttatgaagtatggagtcaaaagatattttcaatccatgattggaaaatatcttactaaaagttgatgtttagtatatttttaaagttctaatgatagccaatccaactgaaaacactgataaaactgaaacaacttgaatggaaaaaagcacaaaacaaagtaagtatataatgtctaaagttgaaaaacaaagagttagcagtataagtaactttttagagatgtagagataaccaccaaaaatcaaaaacagaaattcttaaaaatggatgcctctagggaggcagcccttttgtagttttaagcatacacatctattattttgataaatattcatccaaaattaaataatagaaagaatatacataacatccaatctactaaaagaaaaaataaatctttaaacagcaaacaatatagtaaataaaaactggagttgtgaactatttagaaatgaatatgcgaagaaccctgaaaatatcaaactagataccaaaagtgagagtgaaaccctgttgagagagagagagagagagagcaaggaagagcaataacatggaagctgcagcaaagaatcctgaaaatatcaaactagttacccaaagtgtggaataccacactagataccaaaagtgtggaatgtagctgaaaaccgtactcagaaaaaaaaattatcttaagtgccagaagaaccagcttcaagattttagggcatttacagtagttgcagtggaaccaattgcagtggaatctaattggctgtggaatatttgaacatcaccgctaggtaataggaaaaacatgtcaggcgactcttcacgaatttacatgaaacatcacctgaggattcctataattgatttttataactttagactggagcttgaggtccggccaacagctggagaaaggaccaacataattttagttgttattgatgatatttatctcatctgtatctacaggtaaaaaagagctataaatcgagggaatatttaccttttggtaatctccttgaatacaaaggacggacatcagtgattccgtgagggtagatgttatatggtctgcttgcttgattcttaaatataatctgaaagtataagcgagatctaagatcaaatcctaaaacgactaggatcaacaagaaaactgtggtctaactccagataaataaaagtggcctctatctacattatagtaatttgaggctagataaaactcaaaatatttggtcttttcatgaaattgttccttggcatgcatggaggattggttccaggacccctgcagataccacaatctgtgatgctcaagtctcttactcaaaatgatgtagtatttgcatataacatatgcacatcctctcatgtactttaactcgtctctagatttcttacagtacataatataacataaatgctatgtaaatagttgttttaccgtattgtttctttgtattattgtttattgttgtattattatcttttattgttttggggttgttttttgaatactttcaatcaatggttgtttgaatatgagactagaaatccagtgatactgaaaaataaaaataaaatcttaagcatccccaaacgactgaagagacccctttctcggccaaggagaccccagagatggcttaaaaactgagtttctgaccatgatgggatgggagatcgggcatgccttgttacattccctccctccctaatctgccgttagactttctttcttaagggttaaacataaaccagtcctttctaaagacgtggtggattcccctccctttgtgcagttttatcataacaaccgagaagcattgcttcctgatgagagaccactgaccatggactggctctggccagtttacagaggctgcctctgtgtcctctgtttcatcttttgacatatacagcctaattttcatgcatctaaatgttaagtctccaccccaaagtgaacatggaatgtatgtaacatgtgtggttgcaggtgccccatcataaatattcacagctcctcctggaacctgttaaatatgtatacttagccaactcattcagcataaattcttatctcatccttccttcttcaaagtgcttgcttccatttgctgccagaggctacacttcccagcctgcaaccctttccactccaaatttacaaacttaggattcttcagttgacaatgtagagggctgacagtacttaggtttctctctaaaggcccctttccacttctttaaaaattgtttcaattgcttcaggaagtattctctgcaccttctcacactaattgaaatttagatgcctggtgaggacactgcttcctctcagcctttattactatttgggcattaaattcactgataatagagaaagagacagtgtttcaggagataaaatcttcagtgcatgagcaggcatgaccaagaggacagttgattacagtattaagcaagggtagcaggtggtattgcctgattgcaccagctttaaaagaaaacaaaggcctaggtgcagtggctcatgccagcactttgggaggctgaggcaggaggatcgtttgagcccaggacttcaagaccagcctgggtaacacagtgagacctcatctctacaaaaaataaaaaaattagctaggcgtggtggtgcatgcctatagtaccagctacttgggaggctgaggtgggaggatcacttcagcccaggaagttgaggctgcagtagtgagctgtgatcacaccacagcactccagcctgggtgacagaatgagaccctatctcaagagagagagagagagacagagacgagagagagagagagagagagagagagaatggaagagcaataacatggaagctgcagcgaagaaccctgaaaatatcaatcccacctccagatctgaggtgtgtgatatgaggataaaaatgcaacttccacttctgctcttgtcttaaaacccagtcattcttcctatccatgagcatggaatgttcttccatttgtttgtgtcctcttttatttcgttgagcagtggtttgtaggtctccttgaagaggtccttcatatcccttgtaagttggattcctaggtattttattctctttgaagcaattgtgaatgggagttcactcatgatttggctctctgtctgttattggtgtataagaatgtttgtgatttttgcacattgattttgtatcctgagactttgctgaagttgcttatcagcttaaggagattttgggctgagacaatggtgttttctagatatacaatcatgtcatctgcaaacggggacattttttatggctgcatagtattccatggtgtatatgtgccacattttcttaatcagtctatcattgttggatatttgggttggttccaagtctttgctattgtgagtagtgccgcaataaacatacgtgtgcatgtgtctttatagcagcatgatttatattcctttgggtatatacctagtaatgggatggctgggtcaaatggtttttcttttgttgcttgttggttttggtgtcctatccaataaactattgtctaattcaagatcacaaagatttatcctgttgttttcttataattttgtagttttagctcttacattttatctttgatccattttgaggtaatgtttaagtgtaggattcagcatggtatccagagtataacctgaataaatcaaagaatggggtagatctatatatgttgacatgaaatgatatccaaaatatattgttactttttttttttttgagacagagtctcactctgttgcccagggtggagtgcagtggtgcgatctcagctcactgcaacctccgcctcccagattcgagcgattctcctgcctcagcctccagagtagctgggactacaggcatgtgccaccatgcctggctaattcaaaatatattgttaccttttaaaaatcaaggtacagaccaatttacactgctcttgtttttgtgtgaaatgcacacacacacacacatacacacacacatttgtacatgtatgcactacttctggaggggagtatacaaacccacagcaatgactgtctgtcagactatggggttggaagtccaagagggaggaaaatttacattttattgcatgctcttgtttatctatttttaaattagccagtaaaagtaactcaaaatacacaaaaagtaccctataaatatgtaaaattattgtgtcattatgcattttaaaaattaatgaataaaaaataaaattatacaatcttcaaaaaatgaaaaatagaaaaaatacgtacacaaaatttatgaagaaaaattgtacaataatagctaataaaaattttgaagaagtacaatgaaagaagatgtcatacagatatcaaacatatcacaaagttgaagtcattaaaacagggtggtaacagattagttaaggagaattaaaaatcccagattttagcaatttagtatatgataaagaagacattttcaaattaatgaaaaaaggattggttgtgtcagctgccatttgggaaaatttctatttgaattatgcactacattcaaaagtaacttccagggcaattagattgctcactgtaaaaataaagctatacaagtaagagaataaaatatagactatttttgtagtgtcttgggggtggcaaagacattctcaggcagaaaacataagtgaaaaagatccagagacatataaatgaaaagattgataaaagataggaggttttgactatataaagatgaaaaatctttgaaggacaaaaaatatcataaaggagttaaagtacaagtgacaatgtgaggaaaacatttgaaagataaataacaatgtgtcaatatccataatctataaagaccttttacaaatacataagcaaaagatgactgaccaaatagaaaactggacaaaatttacaagcaggcaattcacagagggagttatacaaatagccaacaaacatgaaacaatatacaatttgaccactaaccagggaaatgcaaatgaagacaacatataaacattttgctcatcaaattggaaaattttctgaaggtttataatatatgttgttggcaatggtgtggggaaaagggcagtcatatacttatggtaggggatataaattggtacaaaattgctgaaagtcagtttggcagtatctaacaaaactccatatctaaaaaccagtgttcttcatgacattcttcagcggctgaatttatggaaccaacgaccaatcttcaaatttcttgtgaagaaaataaacccttatttatttaaaccactgtccattgagtattctgttacttacaccatactcattcttaatatcctagatcaggagcaagcaagcattttttggaaaaggctggatagtaagtactctaaaatttgtgagccctatctagcctctgtcacatattctcttgctcctccgccttctcctccccttcctcccatcctcctttcttttctttgcaatattttaaaaatgtaaaatctcatctaagctcatggactgttcaaaagcaggccacaagccaaatttggttcacaggccatagtctgctgactcctatatgacataattaatggagaaagatctggaaggatatgtatcaaagtctaagcagtatttcaaaggagtgtcgagtttagtgggtgacattaaatttttattctatatactcaaactttaaatacatacaatcagctattatttgtgtaacatttatagcttttaaaagatcatgtccattggagacaaggctgaattatgaggtattttagaaactcaaaactctccagactttttcttcttacctgaccttaaatcttttcttcaacttaccaacagtgtgtctccaacttccccataaagtaaaggtcccaagattcctgattcatgctgaatagcttcacgagtcttaaaggtttcatctgtgtatgccataaatcggacttttttgtacttcctaccaatccgctgagggccattgttcaaatattgacttttataacttctgtataagagaaaaaaagatgagaggttgggaagaaaaattctaggtaggctcaaatccaactctaaaacagcttatatgattcaatcaaggcaaggagtgagaaaaatacaagcttctctgatgctcagctatgttagtttccaaatgttaatacccttgccatttgattccatacctgtacctaaccttaaacatggcttcaggatttgttggtttgaataactggtaagaactttttgagtatggggaagagagagtaccaatagtcaaaaagtgcttacctgtcatcgggggcgaggactaagggagcatagtcccagtcctcctcttcagcagcaatgtaatgtacccaagttttaggatgcttcttggcaactgagcgaatttggataaaggaaggagagttgtcatcatcaaacctgaccacatccatttcagaatcagtaagatcatcatcatagtcttccgcttcttcattatttttcattcgtagttggggttcctctggacagctgtctactttgacataagcttccatgccatctggagtcagacaaaccaaacaatgtcagagtgtcttgctatattaggctgttctataccagagactaggtaatttataaagaaaagagattgaattggctcatgtttctgcaggctatatgggaagcatggtgctggcatctgcttggcttcagggaggtctcaggaagcttacaatcatgggggtaggtgaagggggaggagacatgtcacatggtgaaagcaggagcaagacagagagtgcaagttgccacacacttctgaatgaccaaatatcatgaagacagcatcaagccatgagggattcacccccatgatccaaacatctgccaccagaccccacctccagcattggaaattacaattcaacatgagatttcagtgaagataaatatccaaaccatatcacttgccttaacttttatgacttctttctctcttattaggccttccaggctctcccctaagtaccccccctttccacatcactatcccttcttgccacaaatcattgatttaataacagcttattgggaaaaatgttagtgtagatataaactttaagacatgttccaagttcataaaaccatgacaagatacaacttaaaatcaaggagatatatattttaagagcatgtctgcctgtgactagttgtaaaccctatggcaaatgtattcaacattctcagtctcatcttcatgctttgtaaaatggataataataattcctgccctatttataccacagggcaattttgaagatcaaatacttctaagaagggagacctgtttacttgattatgaggaacagggaaggttttaggagcagcaaacaactagtctggggttcatgtagccttaaacataactcagtctgcatcgaaaaacaaagtgtttggtctgaggttcaataagataaagcatttttttctgaaaaataaagattaaaattagtggatagaatctgtgaaaaggagaaaaacaaaacaaaaaataaactgaatcggggtccaactggacaatgattgattgacaatgatcatatacaagtaaatgacctattcctctgtgcctgcaagaatgttgtttgtgcatcaacttcctgttactcattcagtatgacacattttgtccactaaggtcttgtcaaaattccataaatattatgtgacacatggggaagagagatttctattcttaatcactacagaagacaataaacaaggtcactaatagaacataaggaggaaaatggtggatgcatggcaagatcaattctcttttctaagtcaaccaaggaacctgaggagaaggttaatatgagagtaataggaagaaagaaatgctattaaatataaaagattaggcctctccgacatttttctccaataactcttgctatggtttgaatgtctgtcccctccgaaactcatattgaaatttaattatcatcgtgatggtattgagaggtgaacatataaaaggtgtttaggtcataagcgttccaccctcatgaatggactaatgcagttatctggggaaagtgttcatgggagtggatttgttatcacaggagtgagctcaccctcctcttgctctctctcaccctttctttgcccttttgtcatataatgccttccaccatgttaagacgcagaaaaaggcaacttgatattggacctcccagcccccagaaatgtgagccaataaatttctgtccattataaattacccattctgtggtatactgttattgcagcacaaactgactaagagccttcaatggccacgagaggggtagagaaagagggttattaggttgatccaagattaagagttagcagaataaatacaaaagtaaggaaaattggggtgaaatgatgatgcaatctgaatttgcacaactagcagttacaaataaagttacattaacaataatttaaaactgtagttaccatcgtcctaatttgcttacacagaacctttgaccctttccaaagttcccaccaaatagtcctttcaatcccatgttacttctaaaattcactagctcctgacctgccctcagtttcacaggtgtctctcatctactgccaggtatctacagagtgcctctggctgtctggtgtctgaagtcaagctctacaatagcctgtcatatttgctatttactgctctgggcattactaatgatatagtggagcccttacagttgcaatctggacaatgcctttttttcccatttccctagatttctccaaaaaaaaaaaaaatctcttcagctacaacttgcagttcctctctccataatattggagcgtaattaatgggataaggctgagaaaccaagggcatactattctcctcattttcccacctcaatcatccataagccatcttttctccatcacagacatttaactaaaaatccatgagtcctactaatactcaagcccttttatagtcaaggtaaaaactttacactggaagctggaaactaggggatcttggctgaggtctaatacagtaactctataatgtccccttcagcaacacactatattcctgtacattgtccagtaaattttattaaaagtaggactggatatttataatattcattttaaagatccaagatattaccatgttggtgggaagagatatgacaaaacagtagaaactgtccaaggtccatcaagagtgtttgagcagtaaggaaagttattggcgagatttccaaggacgcctggcgatggttcctcacaagaaatgtgtgaccttcgaggaatattgagtgcacttcaggagtggtgcccattccaatcacatgccaatagactgatttcctgtggcatccaatcagacctgtaaagtaggaataagacacctatggctatgaagtagagaatctgaaatggaaaacacttgctaggacagaatggacaaattgactttagacactttattgctaccttgacttgtaaacaaatttatcaagaacattgggctactatcaaaccaacagctcttgccaaggtcaccaatcaccatcatgctgctaaatccaatggacatttttcagtctttatttgcacctgttgaccattcattcgtttttaaaactctctcttcccttggcctctgtgccaacatctctgtgggtttttttctcctacttctcagactgctccttcttctgtctcccctgctgacctcttctggaactccaggctcatacagccaatcactttctcaacatctccacctagatatctcaaaaaacccacatgttcaaaaccaaatttacaattttcatcacttcattctcttccagagttttttataacagtgaatggcagcatcctgcatttgaatatgcaagtgagagttatccttgttaccattctcatctcccatatgcagtttgacactgaccagggcaatataatcaataatagctaatatgtattgagcacttgttttatgtcaagcactgtccaaagtattttacaagttttaattcattcattcctcataacaaccctatgaatgtagaaaccattatcatccatgtcttgcaggagaggaaacggatgcccagagaggttaattaatttgctcagtatttgaacccaagtagtcatgtgttcagatcccacactggtaacaacaagggcacagctgcctcctattttggctctaaaagctttcaaatgtatctagtttttcactgttactactaccactatcttaatccaagttaccattatctcgtctgagctactgataaactttttttacaggtctccctacagttggtcatattctcccctctaagacttttacccacaaagaaactggtgtactatttctgcattccagatctgattgtagtatccgccagcctaaaacccactggaggctgtcattccacatagaataaagtccagactctctactaaggactagaaggccccaataggtttgattcctaatacctctaacagcttcatctcacattgcctcattttcccagtttcaaagctaagttcaaggggtacttgcttagggaagccttctctgattccccagtctaggtcagattcctgtattataggcttacatagaattatgtaattttccttcagagtaatgctcagtttgtaattttgcatgtattattatgcttatttgactacaatctgtccctccactataaggtatgtgagaacaggaacttgcatgttgtcaaaattaatttcctttttaattataaaattatgcatgtttattatcaaattattgaaaaatacggaaaagaactaaggagaaaacatccccctcatacttcattattctcttgggttgctgaatctcccaaattcctcttttatgtagtttctggttttactatagtacacattcagtgactattaaggccctctatatatgaaaatgtcttttttcttcccccaaaattgattcatagtttgactaaaaattctaggttccaaataatttttcccttagatcttttacaatattgcttaattatatcgccagtctaattcccattcttttgtatgcgtcctgttcctctcagaagaagctttaagtatcttctctctgtgctctgaaatgccacaatgataattttgtgtgtgggtctttttatttatcctaatgggcaattttatttttttaactgtattactttttattgacacataaataattctacaaatttatgggtacaatgtgatgtttcaatacatgtatacattgtgtaattattcaaatcagggtaattatcatatccatcaccttaaatgtttgtcatttctttgttgtgagaccattcaaaatcctctcttctatttgaaatatacaatatattattgttggctattgtcaccctactgtgcaatagagtaccagaacttattccttctatctacctgtaacattgtacccattgaccaatctctccccatctcccacttcccccttatcttcctagaatcactaatctcaactactatgagatcaaattttaaagattgtacataggactgagatcatggagtatttgtctttctctgcctggcttatttcacttaacataatgtcctccaggctcatccacgttgttgaaaatgacaggatttcatcttttttaaatggatgaatagtattccattgtgtatctatatcacagtttctttatccattcatccattgatgggcatttaagttgattttatatcttgactattgtgaataatgctgtcataaacatggggatgcagatgtttcttcaacatgctgatttcatttctttttggtatatacccagtagtgggattgctagaaaatatgatagatctatttttaatttttgaggcatctctataccattatctctaatggcttaactaatttatattcccaccaacagtgtataagggtttctttgtctccacatccttgctagcacttgttattttgtcttttttataatagtcattctaacaggggtaagtgatatctcattgtagttttgattttaattttcctgatggttagtgatgttgagcatttttcatatacctgttggccatttgtaggtctcttttggagaaatgtctattcaggtcttttgttcatttttaataggattatttggacttttgctattgagttgtttgagttccttatatattctagatatcaatcccttgtcagatgtataatctgcaaatattttctcccattctataggttgtctcttcactctgttgattgtttcctttgctgtgcagaagctttctagtttgatgtaatccaatttctttatttttgcttttgttactcatgattttgaggtcttgtctaacaaattcttgcccaaattgatgtcatgaaatgcttacactatgttttcttctaataatttcagagtttcaggtcttaaatttaattccttaatctattgttcttttcttttctttctgtctttcttttttttttttttttttttttttttgagacagagtctcactctgttgcccaggctggagtgcaatagcacgatctaggctcactgcagcctccacctctggggttcaagtgattctcctgcctcagcctcccaagttgctgggactacaggtgtgccaccacacctggctaattttgtatttttagtaaagacggggtttcaccatgttggccaggccggtctcaaactcctgaccccaagtgatctgcctgccttggcctcccaaagtgctgggattacaggcatgagccactgtgcctggcctatttgactttcatacgtggtgagagatagggggtctaggttcattcttttgcatatggatatccagttttcccagcaccatttattgaaaagactgttctttacccatcatgtattcttgccaacttcgtagaaaatcagttggctttaaatgtttgggtgtatttctgggctctctattttgttctattggtctatatgtctgtttttatgtcaacacaatgctgttttggttactataactttgtagtataatttgaaatcaggtagtgtgatgcctccaggtttattctttttgctcaagacttctttggctctttgggattttttgtggttccacacaaatcttaggattgtttttctatttctgtgaagaatgacattggaattttgataggaattgcattgaatctgtagattgctttggctttaataatattaattcttcaatccatgaacatgaaatatctttccatttatttgtgtcttattcaatttctttcatcaatattttatagttttcattatagagatctttcacttccttggttaatttatttctggacattttttgtagctattgtaaacgtgattgctttcttgattgctttttcagattgttcactgttggcatatagacatgctatcaattattgtatgttgattttgtagactacaagtttactacattcatttactagctctaacagttttttggtgtagttttggcagttttctatatataagatcatgtcttctgcaaacagggacaatttgttttgtttgtttttgtttttgtttcgagacagtgtttcactctgttgcccaggctgcagtgcagtggtgcgatcttggctcaccacaagctccgcctctggggttctagtgattctcctgcttcagcctctcgagtagctgggactacaggagcgcaccaccatgtctggctagcatgtgtgtgtgtgtgtgtgtgtgtgtgtatttttagtagagatggggtttcaccatattgccaggctggtctcgaactctggacatcaagtgatctgcccgccttggcctcccaaagttctgggattacaggcataagccattgagcctggccaaacagggacaatttgacttccttctttccaatttggatgtcttgcctaattgctctggctaggacttccagtactgtgttgaatagaagtggtgagggtggatatgcttgtcttattccagttcttaaaggaaaagctttcaacttttccccactcagtttcatcttgtttgtaggtttatcatataggtatgctccttctatactttgttgagagtttttatcatgaagggatattgaattttgtcaaatgcctttactgtgtctattaaaatgataatataatttttgtccttcattcttaatttgcatatgttaaaccatccttacatcactgggataaatcccacctgatcatggtaaatgatcttttaatgtgctgttgaattctatttctagtattttgttgaggatattggcctgtagttgtttgttgttattgtgcttttgtctggttttgggatcaggataatgatcattatcctcctaaaataattttggaagagtttcttccttttcaattttttgaatagtttgtgaagaattggtattagttctttagatgtttggtagaattcagcagtgaagccattgggtactgaacttttctttgatgggagactttgtatttttgcttcaatcttgttgctcattgttgatttgttcaaaatttccattttttcttgattcaaccttggtaggttgtatgtgtccaggaatttatccatttcttctaggcttttcaatttgttggcttatagttgttcatagtagtttcttataattctttgtatttctgtgttatcagttgtaatgtctcctttttcatgtctgatttatttctgtttttcttctttattatcacttagtctggctaaaagtttattgacttttttttatcttttcaaagaactaactaactcattatactgatcttttgtattttttagtttctattttgattatttgtgctctcatctgtattcattcatttcttctaataatttggggttttgtttgttcttgtttttctagttccatgagatgcatcattaggttgtttatttgagatttttttttgatgtaggcatttattgctataaacttttctttaaggactacttttgctgtatcccataagttttggcatgttatgtttccattttcatttgtttcaagaaattttttaacttctcctttaatttcttcattgacccattgtttgtttaggggcatgttctttaatttccatgtatttgtacagttgttcctcctgttgttgatttatagttttattccattattggcaggaaaaaaatacttcattttaaaaaagttagttaagacttgctttgtggcctaatgtataatctcctggagaatgttccatgtgcagttgagaagaatgtgaactgtgtagctgttggatggaatgttccgtaaatgtctgtttgctctatttggtctacagtgcagttcaagtccagtgtttctttgttgatattttgtctggatgatctgtccattggtgaaagtggggtgttaaagttttctactattatttcattgctgtcttcatttcccccttggtctattaatgtttgctttatattaggttggtgcaaaagtaattgtagtttttgcccttacttttaatgagactagaaaatacaaagatcaaacattaatatatttaggtgctccaatgttgggtgtatatatatttatgcttgttacattctcctgttgtattaacttctttactattatataatggccttgtttgtcaatttttttttgacagattctcgctgtgtgcccaggctggagtgcagcggtgcaatgtcggctcactgcaagctccgcctcccgggttcatgccattctcctgcctcagcctcccgagtagctgggactacaggcgcctgccaccatgcttggttaatttttgtatttttagtagagatggagtttcgccatttggccaggctggtctcgaacttctgacttcaggtgatccacccgcctcagcctcccaaagtgctgaaattacaggcatgagccaccacgtctggctgtttgtctctttttatagtttttgacttgaagtctattttatcagatataagtatagctattcctgctttctttttgtttacatgtgcatggaatatctgtttctatcccttcgctttcagtctatgtgtgtccttacaggtaaagtctttctcttaggcagtatgtagttagatctttttttaaaaaaaaattcattcagccaccctatgtctttttttaaatttttttatttttatttttattatactttaagttttagggtacatgtgcacattgtgcaggttagttacatatgtatacatgtgccatgctggtgcactgcacccactaactcgtcatctagcattaggtatatctcctaatgctatccctcccccttccccccaccccacaacagttcccagagtgtgatattccccttcctgtgtccatgtgatctcattgttcaattcccacctatgagtgagaatatgcggtccaaatgtccaacaatgatagactggattaagaaaatgtggcacatatacaccatggaatactatgcagccataaaaaatgatgagttcatgtcctttgtagggacatggaggaaattggaaatcatcattctcagtaaactatcgcaagaacaaaaaaccaaacactctatgtcttttagttggagaatttaacccatttgtattcaaggtaatttttgataggtaagaacttggtagtgccatatttttacttgttttctagttgttgtgtagatcctttgttcctttcttcctctcttaatctcttcccttgtggttaagtgattcttctatcagtatgttttaatcccttgctttttatttttagtgtatctattataaaaatttttgctttgtaattaccatgaggcttacacagaataccttatagttataacaagttagtttgaactgataacaacttaattttgattgcaagaaaattttttaaaaaatcgactcccaaattttgtgtttttgatgtcatcatttacatctttttatattgcttattctttaacaggttatggtaattatttttatctgttttgttttttaatcttcctactaaggatataagtgatttatgttctacaattaccatgttagagaattctgaatttgtcgggatacttacttttacctgtgggttttataccttcagatgttttcatgttacacattaggacctttttctttcagtttgaaaaactccctttagcatttcctgtaaagcagatcaggttgcaatgaatttcctcagtttttttttgtctgaaaatatttttctctctctttcatttatgaaggataattttgctgtgtacagtatccttggctggcaggtgtttttttttttttttctctctctctcattctctcctggcttgtaaagtttctgctgagaaattcacagttagtctgatagcggctcctttacaggtgactatatgcttttctcttgctatttttaaatttttttctttgacttttgatagtttgactataatgtgccctggagaagacctttttgcattgtatttatttgggtatttttgagccttctttatctagatgtctaaatctcttggtagacttggaaatttttcatctaatatttcattaaataggctttctaacctcttcattttctctttgccttctgggacactgaagattcaaatatttggtcactttatagtgcctaatatgtcatgaaatctttgctcattttttaaaattcttttttctttatttttgtctgattgggttatttcaaaagatctgtatttcagttctgatactcttctgcttggtccggtctattgttgaacctttcaaatctattttgtatttcattcaatgaattctttggttccagaatttttgtttggttcttttttgatatctatctcttgggtaaatttctctttcatagcctcaattgtttttctgtgttctttgtatttttttcagaattctcttgtatctcactgagtttatttagtatcaaaatttggaattatttttccaggatttcataaatttttaaagagatgttggccagtttacttaaaaaccaatggtcacatatactgttttgcttgtaaactatgatttttttattttgtggatacatagtaggtgtatatatttatggaacacatgagatgttttgatacaggcatgtgatgtgaaacaaacacatcatggagaatgaggtatgtataccctcaagcacttatcctttgagttattaacaatccaattacactctttattttagaatgtacaattaagttattattaactatagtcaccatgttgtgctatcaaatagcaggtcttattcattctttctatttttttgtacccatcttaaattttttttatttggatctcttgctacagaattattgtgctcctttggagtgtcatagttccttgatttttcatgtttcctgtgtccttacattgatatctgcacatctggtgtaataatcactttttccaatttttaaaatttgcttttgtaggaaagaactttttcctgaagatgtatctgtggtgttgcttgggtagagcacttcggttttgattctcggtgaatgtagtagcctctgtataagattctaaacagcatcagtgatatttgtgattttctcagtggcttagggtgtggttattagtggaggctgtggtgaagtttttctgagaagtgggatgccaggtaggcctgtcttcaggccccaatggtggcagcagtgggctgagtgtgcttgtctttggtgtaccatggtggcatatgattgcactggttttaggtccaggcaggttgatttgtgggcctccaagtggtttacttgggtgccagaagtggtattgatggatcacatgggtgggtgggttctcaagttcctgggcagcaaagtggcatggttgatggcaatcatagcaatgaaacaacctgaatctcaagtggtctgtgctggcgttggttgtggctgctatggatcgcatggccagtctccagaccctcaagtggtgcatgcagtgagtgctaactgtggcagtagtggcaggttgagtgggcctgacctcagaccccaggaggtgctcaggtgccaccagtggtggacagggctaagtgatccctaggcccctggatgatatgcttgggtactgggggcaggtagagctgggctacgtgaacctgccctcaggctccttggtggtgtgtgaggtgctggttgtgctatgcaggggtggggtgataccgaggtcactagcaaaatgctcaggttggggtgcagcagtagctgtgctatagccctgctcttggtgaaggtggggttgctttctcagggagtagctgtaggcaggtagcttgggagcacaaggttcactagtgttttggccccacagcagcctgcagcagcagtggttgtaggtagtggaatttgttcttggaatatgtgaaaatgcatgggcactcctctgctgggtggggcaggatcactgctcagggctcctgcctaagtcacggccatcatagcagggcaggatgtgtgggctgtgttctcaaaatggtgctgtgctgcagctgcttgggagaattgcagaatccagcgtgagctctctgttgcaatgccttcacacggtctttaggcaactccctatgctagtctctgtgctgtcaaggaataaggcgctctcctgtggctaggattgcaagagtccttggtgaaaatgaggaacactaagggtctcttaccttttccccacattaggaagctgttccagactcccagccaatcccaggcaaacaggccttatttctctctcctcccttgctttcaatgcttcctgtcactgctctgttgaattccagtgttctctcttagatgacctattcaaagtataattatctacttgctactttggttcctctccatggaagggatgaacactagatgcatctagtcaaccatcctgaagcccctcctgattgtatttttggataacctgtctttgagcttgctgatcctttcttctgcctgatcaattctgttgctgatgtcttgtattgcatgtgtcattttttattatacttttcagttccaggatttctgactttttttattccttcaatttctctgttaaatttctttgataaacttctgaattgtttctctgtgttttataaaagtttgttgagttttcttaaaatagctattttgaattctttgtctaccagatcattcacctgcatgtctttaggattagtcactggcacgattttttgttcatttgttgaggctgtctttcttaggctattcttattctttgcagatgtgcatccctgtctacacattgaagaattaggtatttattctcatgttcacagtctgggtttgtttgtgactgctctatttcagtgagctcgtttagaaattgagtggggctgagtgtggtggctcatacttgtaacctagcactttaggaggctgaggctggaggattgctttaggtcaggagttcgagacccagcctgagcaacatagcaataccccaatcttccccaccccacacacaaaacccgaaaatttagccaggcatagtggcacacacctgtagtcccactctggaggctgaggtgggaagaccgtgtgagcccagccaggagttcaagactgcagtaatctatgatcgcaccactgcactccaacctaggcaacagagaccatatcaaaaagaaagtgaaaggactggctgttgtatttccttttagcacgagagggcgccctgagcccaggttagacgcaagtctcatgctggctctgctactaattagtggagatccacagagggcactcaggccatacgggagagttttccggtgtaaaaaccgtgggtccatggtgactttccgcctgtggtactgcagtggcttgcgggtggggtctcagtcataaagaaccaatcccctttatgtgcaactatggttttactcgtctttgcagtccaaaagggcttcacagtcttgctcatgggttcaggttttcttaactcttctgaaggtaatttcacgcatcgagttgttaccttgatgtttctgtgaggagattattgctgaagagtcctattccaccactttgctccactcagcatgcactacttaatcacaagcaggagatgaaggcccggaaagaagacaatagaagcccaaacccctctcctcaacctttatctagtagaccacagtgtccttataattcagcagtcagcaccttttcttataaacgccagatggaagagatgcatatataaggaagggtatgtgggaaggggcatggggccagccactctccaggaacctccatgcgttcagctactcagaagctcctgatgggcaattctaatatgaatatttatctcttttaattcttatcatttttctatcatttcttgatgttaaaatctgctttaaaacacacagttgactcttgaacaatacaggtttgaactgcatgagtccacttatatgcagttttttttcaataaatatagtgagatttttttggaaatttatgacaatttgaaaaaactgtcagatggaccacatagggtaaaaatatcaaaaaaattaagaaaaaggtatgttatgaatgcaaaaaatatatggagatggccggatgcagtggctcacacttataatcccagcactttgggaggccaaggcgggcagatcacgaggtcaggagttcaagaccggcctggcaaacatggtgaaaccccatctctactaaaactacaaaaattaggtgggcgtggtggcacatgcctgtaatcccagctacttgggaggctggggcaggagaatcgcttgaacccaagagggggaagttgcagtgagctcagattgtgccactgcactccagcctgggtgacagaacaagactccgtctcaaaaaatatatatatatactttgggaggccaaggcgggtggatcacgaggtcaggagatcgagaccatcctggctaacacaatgaaaccccgtctctactaaaaatacaaaaaattagccagtcgaggtggcgggcgcctgtagtcccagctactcgggaggctgaggcaggagaatggcgtgaaccccggggggcagagcctgcagtgagctgagattgcgccactgcactccagcctgggcgacagcaagactccgtctcaaaaaaaaaaaaaaaaaaaatatatatatatatgtatacacacttatatatacatatacatgttgatactagactattttatcatttattaccataaaatatacaaaaatctattataaaaagttgaaatttataaaaacttacatacttacaaccatacatggcaccattcccagttgggacaaatgtaaacaaacgtaaagatccagtattaaatcgcaactgcataaaattaacggtagtagccatctcctattgttattgtgctgagctcgagtgctgcaggcatccactgaaaactctgcatgatgctaatcatctctgcataagcatttcatctctccataaactttgaaggatacttgggacccgtataaagtgccactagtgatgctggaagtactcccaagaagcagagaaaagtataaataacattttcctttctctagcttactttattgaaaatatacagcatataatacatacacaaaatatttgttgtttatgttattgataaggcttctgatcaacaataggtcattagtacttgaatttggagggagtcaaaagttatacatggatttttgactgtgcagggggttagtaccccaacccccacattgttcaagggtcaactatattctcaaccacattttgtttgaccttatgaaagattttatctattcttagtactttctattgagtttctattttgaccattgtgtttataatttttatgagcacgttttgttatgattgtttttcatagaatcctattgttaccttatttttaagtttctttttattgatgtaaaatatacatatgtaatttgccatcattaccatttttaagtgtacagttcagtggtatatatacataatggaatactatttggccataaaaaagaatattttcatttgcatcaacataggtgacactgcagggcaataccacatgttctcactcacatgtgggagctaaaagagtggatcttgtgaaaatagagagtagaatcgtggttaccatagtctggggtggggagggtggaggtgatgaaggtgccagttgggacaaatgtaaacaaacgtaaagatccagtattaaatcgtaactgcataaaattaacggtagtagccatctcctattgttattgtgctgagctcaagtgctgggattacaggtgttccagtaagtggtcagagccctgcctgtcccaagtgggtgaggtcccaaagggattatcatagcagtgttggaaggccagctagtgattcatgccaaggtgacctgtaggataaacctgctacagcatggtgctgctgcacggccattctgaatttgcatgtctttggccaaattatagagcagaatttccagggctggggatggtagtccttcctccctcatttgtctctgcctgtactctgggatatttctgccttcagacagtcatgatgttttctgtgggttaaggcaaggacaaatctccccccagggaacccaagaaggtggagaagctggttgaacacctcaatgtcactttttccagtgtagaaaccatgagttgaggggagattttccatacacttggtgctgggcagaataggaggaaggagagtcatggatgtggaagtctgattctcaaagttttttcacttctctgtggctccgggaactgtctcatcctcacatgtgagctctgggttgttgttggtgtagatattggtgctgtatgtttggttttggttttctgtgagagggagtaaagccagcctgcctctatgcccctattttaaaactggaaggcatcttattgttactttattgatgcagtatcttcttgaatctttatgaaaatagaagtaagagcttccgatgagttctgttctgagccatagctttttttattctgggattattattttctttgttcatctttgcatatcccttccatattttaggttctttttaaatgtctgttcatccttggttgcccactcacatttaagaaaaggaaagaaaaatctgactgtgggctgtatgtacatgggtaagccttcattttcaggtgaccaaaagaggaattgcctactatacattaagatccccagaggccagagatcttcaagtattcagtgggctatatcctctgagatgccgagctgtttgtgaactgaagtacagaactctggtgctgaatttggaagaccctgaggattgttgagcaggtgtgtacatacctggcagagacctgtttacataaccattgactgtgtgcattttaggccaggcccgagcagatgcagcatccctatcctgcatcaaggagttctttgtttctgagtgccaacttttccctgatgagagagaaggcaaagatagagtcagctaagcatgtgtctcatgaatgaccgcctcccctttctccttccctgctcccagtgtgctcacaccttaagcatttttgtcagcaaagtaggcacacagcacttatcctctcaaagtcagtgtgagggagggagaagataattatgtaaaggcagacatctcttgctcaaactgattttctctccctccatttgtccatgacaataagtgggaatggataataatagaagacagaatattggttagcttgaggcatcaggattcaattctttttattagctgaattatttaaaagaaagcttatgaaaatcatcctaggggccgggcgcggtggctcacacctgtaatcgtagcactctgggaggctgaggcaggtggatcacttcaggtcaggcgtttgagagtagcctggccaacatggtgaaaccctatccccactaaaaatacacaaattaggcgggcatggtggcatgtgcctgtaatctcagctactcaggaggctgaggcaggagaatcacttgaacctgggaggtggacgttgcagtgagccaagattgtgccactgcactccaacctgggcaacagagtgagactcgatctcaaaaaaaaaagaaaagaaaaaagaaaattgtcctaggaaaaaggctgtctgtcagtccctgtctccgttataattgcttcatcccagcttatatttatgaaaccccaggaacctgaaagctccctaacactgtctctgaaattgataagggctgaagcactggaaatactattgaacagtgactccctggagttacccctttgtgtgaaggactggtagctagtgctaaaactttatgaggcagccattcatttgttcattcattcaaacacatatttattgagcactactaattgtagacactgatgatagagaggaagatacagcctctgctttcaagatgcttacactctagctggaatcgtcagagaagctgataattataataaagagtaaagagtgatataataaagatgagagtagggtgttacagggagcagagaggagaagaaatttcactttgcttgaagggaaaaagatatgagatcaaagaagataaatattaaataaagtagaaaatactgatatagtatgataaggaataagctcaagatgctgtggaaatataagcaggcatctaatccagactagaggtcatcctgggagaaggaattaaggaaggggataactgaagtaagtcagacttaaagaaaaaggagaagcttacttagtgtaaagagggagacagatttttccaggcagaggaaactgcatatgcagaggtctcatgcaagaaaaagcattacatatttgggtgacatggaagataaggcaggaaatggaacacaacaaggctggaaatgtcaccagagaatagataatgcattttgcactttaccttgaaattgaattattttatttgttttgttgtttgagatagggtctggctttatcacccaggctggagtgcagtggcgcaatcacagctcactgcaaccttcacctcctgggctcaagtgatcctcccacctcagcctcccaagtagctggagtacaggtacccgccaccatgaccggctgattttttaattcttttgtagagatgtggtttcgccctgttgcccaggctggtctcaaactcctgggctcaagcaatctgcccacctcagcctcctaaagtgctgggattacaggcatgagccaccgaaactggcaaactgaagtattgtagaggctagagtgacaagatcagatactcacttcagtaagcttcctttgagagttatgagacagatcatgagggcctcaattaagaagatggcaatgtaaattgataagggggcaagaagaatattatgttactatgattacatagtgattacattaggaggaggaggaagaggcggaggtactaacactattgagggcctactctatgccacacagtgctctaggttacttaagtgaaatcactcagcactcacaacaatcttatgaaaaatgtactattatttccatttaggaaaccgagacacagagaggttaaataacttgccaaaggttgtgcacttaataatagatgaagataagagaaagtatttagaaagtagagcccaaagtatttgttgacagtcttaatgagggggatgaggccagtccgttatccagctcctctatcttcttacctcatagctgccagtggaactgaggttacgttttgttttcttggaattcatttttaaccccatctccttcattcctgaacagtaatgtaatttatgatctttctataatcacctcctcttaatagtagcagaggatttctttcaggaatccaaaattcagattaagactcactaaccttcatcaaatacagcaaaaagtagtataaatttgtgcaaggtctgtgtcttttccttggccagactccctgaaaaagaagtgagaacatttatcttctatttaaaaaatctcattgtaggaaattgtcactaggaggagacagttcttcatcagttacttgacagtaagaacaaatgtagtcttctgtctcttgataacttggctttgatgtcaggtctcctatagcagtgtttctaaaactatctggagcaaagaatttttttatttcaactttgatgaagaccactacttgtgtaaaatatgataaaaatgaattactaaagaaaaaaattaaaaacacttacaaaatacaagccctcacacactgtgtgataatagtgaaattatagataatttctgttactcttgtaactttttatacttctgcaattgtaaattaaaagttttgagtaaaatagcaattgtccatattaaacatctatactcatgattttttttcaatagcccacagtgcttctaattatactcacattttaaataaataccgtgtatatcgatagctgaagtttttaatggaacaaactagcttgtttcatgctttaactgttgagcttgttggctatctttcttagaattatatattttttaaatttgactggaaacttttgtttacaggcttattttgagtagaaagatttttgtttatgacattttgccgttctttctctctctcgcacccttaatgcttagaaataaaaattagcttggactaagaaagcaacagtacgtgtgctgctactcatcaggctgggataagagacatagataaagctaactgcagagttaacaacaccatttctcccaaggacacattgccactgtataaactcactgaatgccaactatttgctttgattatctcttgctttcttactcaattgagttgtttgttctctgaattcacagcctgccagaaatgtttgaactaatagcaacaagaatgaaacatctcattctttcctaggtcatctaaattactttgacacaaagaagcagctcaatttaaagctcaagcttcaggtaaggggtgccttgacttaacctttcatgtctatgttaactttttagaacacttcacagtctagacctcatggttatttctttacacacaactctactttgcttcatttaaatatcacctaacctccacccttccccaaaattctttactaactctatacagtatttccctttgtttagggaggtgtccacagtctcttgttgccatgagccaataaatctgactttgttgaactatagtgatctttgctgtcccttgtgatcattggttgattaagcaaaggatgtgttcactattctctatctagcaaatcataccctagaatggaattttggagatactggccaatggaaaccttggggatattgcagattcccccactgaaccaagaaaacttagttcagttcctattctaggactgggtttgctttcccctcttctaggactctgagtttccacaaagccatggccctaaacaaagagtgagcagcagctgtgctcagctctctttcaagtgaagaagagcccaactctatgatatgggctctcagtccctctggtggggagcactatttatccttgtcatcctgactccttggctaccgcagctggcttcctgacccagatctcagttggcctgtaatttccaccccttttactactcacagttcctgttctgcttctggtccacaaatatttatcttctttttcagctgaccatgcctattcgattttctctatttatggtttacctatctttgttgttggttttcagcgaggttggggttgaggtggaggatggaaaaatggctaagtaggaagaccctgtgccatctttaccagaagtactggattaaaaactttagagacacatttaaaatacgtataaagctgtcttaaaacattctaattacttttatataaattttcaattatagtgaaattgactttttcttttggtgtataggtctataacttttaacaaagatataagctcatgaaaccccatcatcgtcaagatacagatccatttcaatatccaaaaagaactccctcctgctatccctctatagtgtacatctaatttcacaagaaactgccagagactgtttctctaccaagcagcaaaactgccattctgttttccagaatggctataccattgtgcattgtgaaactttctgttgctctgaattcttgacaggattcttggcaattttatattattattttagctattctaatagatacatcactgttgattgaatttgcatttccctaatggttaatgatgttgaacatcttttcatatgtttgtccatataactcttgctttataaaagacaccattaaaagaatgaaaaaacaaactatagagtgggagaaaatatttgccaatcacataactggcaagggatttatatccaaaatgaatttcatattcagacttaagttccatccccaagctatctcattatatatgtgcaaatattccagtatctgaaatctgaaacgttcttggttccaagcatttcaggtaagggatactcaatcagtattttgcatgcagatattcacctgtttcagcactgtttattgaagacactattctttcccctattgaatggttttggcactcctggcaaaaatcaatgttgtgattacagatttgtactacttcaactttcttcatattcatgtttgcatcatatatccttttccatctttatgctggtaacctacctatatcatttttttgaaatgagtttcttgtaaacaacatataattggttcaagcttttatatccagtatgctaatctctgtttttaattggtgtgttttagccatttgcacttaatgtaagtattgatatgtttagatttaagcctatcattttattatgattttactgcttcttctctctgattttcatctctccttacttgccttcttttgagttatttgaatatttttgatataccattgtaattagtttattgtgactttttactgtgtctcttggtataattttttattggttgctctagggattacaaaatacatacttaacctttcactatcatctacttagagtcaacattttaccatttgaattggaatgaagttgaatggaccataaagttttccttaccctcctcttgttatgctatgattcttttatgtattgtatctaccatacattaaaaaacctatctcacaatgttctatctttgctttcagccatcagacatgttttaaggaattctgtgggcgttagtttcagatgaaagtatgatttctcatatactgagttcagtttcatagtcataattaatgagaaagtgccaaaaccacagtgtgttatttatgggacgtaaaggctaatggaacatgttgaagactgtgaaactgagatttcccctcaagcaccagactggccactgcgttggactcaatggcactgcaaggggtttaaaacagatctgacactgaaactacatacctggatgtgtaggttgggggtgaatccaggagttaatgcacaactttatgggtttactttcctgggatcttttctctctgtcatctataaactttccagttctgtgagctcccttttttggttttctaaccagaagcttccaatttccacaactacatcatagctaaggtcaagcaatggaaggggaaagacagagagaaagtaatgtgcttttcccccaatgtcttagatctgtagctgtactgaatgaagaataatgttcccctccctaagtttttactccggcaggtttctgttgccagccactgtcattgccacaggcaacctgggactgaagcttgagagaatggtggaaaagaggacaaaaaccctaggggatttcccctcccacgctctctgagcatttagagttacctttctcactccttgaaaccccagagggtttgtcctggagctctctttgcaacatagtactcacttcgaagtctccagttatgttttaattcaggttaaggaatactagagtggggaaaaaggtatactcccccacaagtttggtaatactttcaattctagtgtcttttctctatatacttgttctatttgctttttagaaatttttaaatatctgggctttgcattttgtcaaggttttatagttaagttcaatgggaaataaagggtggagtgtgtttatccatttcacctggaactagaacctctgtagactctttagttcaactctgtgtcaaagaatcatttgggtttttaacttatttctttatatgtcatatgtaaacactaatgttttgatgatctcattgttccattagcctttacatcccataaataatacactgtggttttggcactttctcattaattatgactatgaaactgaactcagtatatgagaaatcatactttcatctgaaactattataaactacaaacctttctcatcttctccactccccgctcccatcctttttttgaatcacattcatcatcaccattcagaaagagtatggtgattcctgttaataaattctttgcctattccccatcaaaaggtggagtctccctttatagactggtcttagtgatgcattctaactaatagaatgtaggttatgtgagtgatttccaaggttacattagaaatcgtgaaacagcttctaatgggctatctcaggaccatataagaagtctggctaccctgtaaaacccatgtgagagagatcatgtggagagtaccatcaagccaaggtcaaagacatgtgaataaagtcacctttgggatgatttcagctctagccactgtttgactacagcctcatgagacacacttagataggccaccaagtcaaaacactgacaaattccatgagactcacagaaaccatgagagataataagagactgttgttgttttaagccactaaattgtggagttatgcagtaaaagataaatggaacaaggaaaaggtacagtgaagctgatttcaccataaaaaataggataaaaacaaattatgcaaaatttacttccctaatttatgctaaggtataaattaaaaacaggtttgattagaattattttagaatatattaattcaatccaaattaattaattttcagtaacatataaataaatgctgacttttcttagatttttatatacttttggtttacagatgacaaactaaccacctgaaccagtctatatgccattgatcacacacttggatgtgtttacctccatgaagttttcaaggaacctagctcaaagtttgcaaaaggcagaggacagtagaaatcactactgataaagcccacagatttgaagaggaaaatagcaatgctttgaggagagagatttaattctggaactcagctcctcctgatcccagcttagagtttattgtggttatatagaatgcatatctgcttctctcagaaactggattattctcctttccatgagcatgatgctagagtaaaaaagcctctttcaggtgaaggaacacaaatgctaactgttatagatagattcagttgtttgtacttctctgcttatttcatctcaatcctacgctttcatacacttaccttctctacatactagtagggctccaatgaggcctgaattcaagtcttttaccaggtccacatgagaaagatatgagtaggtaaggcacagtgggtcagaggccattggaccattctctttcaggacctgccagacatatgtatggcttccaccagggaagactttatcatcttctttctccctttgactggtctgatcatcatattcagctcctatagcaggaagaaataaaattgtcctttctatatccactgtacactcaaagaaacatgtcaagtttattgtcaccaataggttctacataagaaacggactttctgcatctttgttgttgttgttgttgttgttttgagacggagtctcactctgttgcccaggctggatctcggctcacagcaacgtccgcctcccaggttcaagtgattttcctgcctcagactccccagcagctgggattacaggcacgtgccaccatgcccggctaattttgtatttttagtagagatggggtttcatcatgttggtcaggatggtcttaaactcctgaccttgtgatccacccgcctcagcctcccaaagtgctgggattacaggcgcgaaccaccacacccggcctactttctgcatcttaatttgaaaaactaacaagcagcagccacaaatggggagaagcttcatatactccagaggatcttgagatcactaaccctagcatgagcagtaaaaactaggttctggttgatatctccacattctgttaaataataaattgcttccattattgcatctttttgcctaattcaattcaacaacaaatacactttgtcacagactctttggtaggcactagtgagggtcacggaacagtaagaaagagagatttaagaaaatttcttaaactttgttctttcctagtggtacaacactatgtttggtgggggacatagacatataaagatataattataataccatgtggaaatattcacctatttattcacaaatatttattgagttcttattctttaccagactcagctacaagctgaaaatataaagatcaagatagaagtctctatgcccttggagcgagcaacacagtggataaaaaaagtaaacaagcttcctactcttcagtaatgcttgatgaaggaggtggaatttgagatgaatcttgaaagacagatatatttgtgttctttttcatgtgtttaatataaagaatttaatatttttgtgagtggatgttagaaaattattcttagaattgcactgctactttcacttttttctttcaacacactttttatgatgatgcattttaatgtacattacaaatttcatgatagtccactcctatatactttagaagtcatctttaaaaaaaaattgcccacataaacaaaatgacactagcacacctgatccagttaatatcacctaatatcaatgcaatattcaaattttcttaattgcctcaaaggcatcctttgtagctagttggtccaaatcagaatccaacctaagactgcagattgcatctggttgtttaggcccatagtctcttttagtatggagtagtccctttttttctgacactcatttggtgaaagaaatttggcttgtagtcctgtagaatatcccatgctattgaatatgcctaagttctgattagattcaaattaaataagttttttggctaaaatatatcaaagatgatgctgagtccctcatattgtgccatatcaggggcagataatatctggccatcccatccttagtgacactaaaactgacctgtggattagcctgatacctccattctaaagttaacatttccacttacaatcagaaaaaaatcactgggatattattttggcgccatacaaatgtcaaattccacatcaggaattcacctaatgattgtaacatcagcttggatgtgtttgaagccaatcctagacaggatatcatttcatttatgagtattacaatatgtatctctattatataagtgttgtttttaatgtgatcattattttttcaatgatcaattactttgaactttgacaatgagagccttttcctgccagccccatagaggagtacagactgtatgtaaaatgcttaattttgtaaaataaattaagcaaagatgacaaaatgttaagatttggcaaagtgaggtgatgggcacatgtttgtttgttatattattttctgtatttatctttgtttgaaatatttcattaggaaaaaaataccctttttcccaaggctcacgttgtggtgggggcaggggcgggagcacatgttggaggttcaatgagaggctaacaatgtgtgaaacattatagctgtcttggggagagggagagtaaatggattaggggaaatgtagcagtagaatggctaggcaatgctgaaggcccacctgaggtgagataccattcagtgtgattgcgtgatttttatttcagctatgtccatccctttggttgttggtagaataggtggagaacagatttaaccaaggtaagtgacccagcccagaaagatttgagtctgttcctctccaggaatgggttgaacctagttttccttggacagaagaacttggccaaatctgagatgagccactgcatcaggagcagcaacttcaacatatgctaaacatttcactgttcaatagaaatataatgcaaaccacatatgtaattttaaattttctggtagtcacattaagaaaagtaaaaagaaacaggtgaaattattttaataatgtatttcgtttaacctagtatatccaaatataagcatttcaacttgtacttataaacaatgaatgagatatttttagtcttttttgtacttaacctttgaaatctggtgtatattttacagtatgtctcaagtaggactcaccacatttcaagtgcctgatagctcatggctaccatttgaactgtgcagtatagactctatggttggtgtcccctcattggataagatgtggccatttgggggtcccaaaaggtgttaccttttctgatgggtttaacttgagctggattttaaaatattatctccccataattgtgattttaaagctcttatctctccctgatgtcagcagaaaaaaaaagataaaattgcattggccactcgtttctccaccaatttttggaaaatttccccaatgttgaactacgaatacatgtaactctttaagatatagccaagccgagaccctccagatttgccatggcttcctgtctctgattatacagctacatgtttagggtaggatcagtggtatagaaggagcagataaaggtagattgtcctgcctttgcaccatgcctgcaaagagctaggcaactaagaaaaggacaagaccaacacccccttaagactcctataagatccatggcccacatgatatacatgaagtagtagaatcttgattttattatatttgggctccatcccctaagtataggattacctggtaataataggtcctttttctcataaatttcaaaatgctagtgcaagtactctcattggcctagcttgggtaaggtgcccatctctggaccaatcaactgtggccaaggaggtgggatacccgtgtcaactgctcactcctagatcaactgctatggctagggaggcatgggctttaagaaaatggcaggttctgtttgaagtatattcagaaaagcaattcctagggggtatacaggtgagaaatgtttaattttaggaagaaaaaatgactggtgtccactacaccctcattcttgtattgagtatctactatagggtaggcaatatgttatatgctaaggacacagcaataaataagatggatttccctatcttgagatatttataatctagtaaatgttaagaaatacacataatgttcagttaggaccttaaaagagttgtaacgccaccattacaaagcacacacatctcactgttctattcatagaatgacaggacaataggagggtattttactcaccctcagaagctttccagtaggatacaccaacagcatgaagactgacaggatgggaagccatgttcttaagtgtaatgaccactgtatcataaacctcagcctggatggtaggacctagcagacctgtaagaatgagatgtccgccaaaggttacttggggatagtactccagaaaacctgttattccaaaagttagagtcaaggtcacagtggagaagcatgcccctgtaattactgacaaaaagtagtatttgcttgctgccaacatcagcctaaccttatggttgctctgaggcaagatttctggcaatcattcaattcattcattcattcaactagagttcctactatattctaggaactgtcttatgcactggaggtgcagtagcaaacaagacagataatggagatcatattctcaagacattaagcacataaagaaataaataagaaaatttcaagttgttataaatataaaagatagtggtctgctagaaagtgatgaggcaggaggtagaggatactttcagtgtagtagtcaggaagggcctctctgaggaggtgacatttgagtagagatctgactaatgaaaaagaagcaagattttcaaagatctagtggaagagcattgaaaacagataaaacaaatgcaaacgtccagaggcagaaataagtttggtatagtcaagtaaagtgtggctgaagcacagtgaatcagcagaggagtaacagaaaatatggtcaaaaaggaaacataacatgtaggaccttgcaggccacaggaatttggatgaatttggattttacaagaagtaaaataagaagacttggaacttgttttggaggaacagtcaacaggacttgctcataaatatgatgtggagatagaaaaaaagagaggagtcaaagaaaactcctatgattttggcttgtgcaactgggttgttagtcaggccatgacagaaaatcaggaggaaaattaagagctctgttttatgaatacactaagtataaaatgcctataaacagtctgttgaatgaactggattgagtgggataaaaacataaaatagccttatttttcttagaccactgcttttaattactttatgtgagatctcccttttcttgcactttggttgatcccaaatcttttccagtaaccttcaggtattaaccaacagtatcactcttaggttctaacaagtccagtccagtctaataccaaatttttgatgtcttctgcaattgcaagttcccttccttctccagctacattctgacagccccagaaatctgcaatatgtaaaggtaatttgttttggcagcttcgctgctttcccaccttcctctcctaatcttcctccccaactcacctttgtgtctctggacctgccaaggtaggagcaagtggaaaggaggggggagggtaaaaacaaataggcacaatgacaaagtctttcttggaaggagcagtgataatgtggcattagtactccctagttgtgacacataccaaaattctgcctttctttcttagggaacttatgagttatttggagacctctccctgccaacaaggagacaccccactgctcctgatcttggcatgggatataccttctccagctggtcacttgtatctctcctctcagattctgcttctggcagtacaacccatacaggctttttctattggggttatctaatcctggcaggaagacctctcaggcagagtctttgtaagacaagtcccattcagtgaccttcctggccttacacctaacaatggtagtgcagttagctcccactattgcccactccccctgctattccatcaggagaagtccttttggcctctgaccttgaaaatttatccagataaaaaccaggcagtggtcagtgtctcccaagttccataggtaccttgtccagtcttctaagtggttctcctgaagcctccttcattataccttgacatgagggacaggcctcccactccccatggggtaagcaacacataaaacaccgaagaggctctccaaataataaatattcaaatctaaagtcttccataagttcctagcctttttttatacaaggttggaggtgagtcagggcctaagggttgcagaaccaattttggactactacctgaacaagttctaaatcgataggctgatatctctctttagaataaggggatacttcccacctataattctcagcaacaattctaagacagaaaatgtcctgtcataacatgttgttacatactttatttgacatctaagtggaggtaagcagttggcatagaccaagcagaggaagacggcccagcaaaaagacagaaaatgcagtcagtgtatttccctataggtagcagttagggaaacattctctttggcagctgcactttttaactgcaacctcaagattggggaatctgtgatagaaaataagatacccaatttcataaatagcattcaacattgttttcattacccatccagggtggccttggcttagcgatgttgaaaaggtgatccgtgaattctacaaacagagtctttttgtacacgactgaggtgttgaatggaaaagattttggcactctaggaggaaatctgcgtgaagaaaggaaaaagtcgttcattttggtggacacttcaaaaagcagctggaagtaatgcttccatactactcttttctactattagcaaggaggcaaatttgaagttgtatataaatccctaacatccattaaaccgaaacactgttttcacaactcaactgatacattaggtgccatatgataagaatcataaaatcaataaccatacactgcatcagccaaaaatcctttgccaaagcaatagctactgcatccttcaatttcatctctaaaacagactataactttcatctaagtaccttgtgttcaaattttgtcagtatgtacctaaaattatacttccctccttagggataccaggaatatcacagagaaaattacctttcagcagactatgtatattgaaacctactagtgccagaagctgtaattcagaatcagtcctacattaatgttcattcttgtctccactcagatactcccaattactcatttattcatgaaccagctactgaatcagaaattatataattacttatataaatgttcccaaaatgttattatttgcctccattgtcaaagcccttttaagcaaaggctggttcccaacttttcctctctccctgcatgacagtttagcatgtctgggggcctcctcacgccaaataatcaaaaggaccaatgtgaatcttggtgaataagggacactggccccaagtgaattggtagaaattacaaagtggttgaaggtgactatctccactcactagtttcatgtgctgatgagttttgcacaccatggagcagttctgcagctttctctatgccataaagagcctctcttcctgacttttatgcttctggacatctaacttttatctcccatcagattttaccagttggtatcatttcaacaagccaaaggcacaacacatgggcatttgggtaattaaggcttagttggagaaagcaaggctcctgccctggaaaaaagctttcatgtgtagatctaaaattgagcatttgccctccacagatatacatcgattcacttatgaaccgtatactacatgccactttgccataacaaaacacatcagacataaacatggaaaaggagagatttttaaagacatacacttagatgtgaagcagttgttcgagtcgcatgtcttattgactctcagggacttttgaaaagtggtagatgtgaaagatggagaacagcacaaataaatgcttggtatggcggaccactgaagaaagaaccccaaatatcatccagtgagacactccctccattgtcataaatgatggcaataatgataaagtgagggaaaggagaggcagcttctgattgtaagtattcatatgcttggagtaaaagccacaccatgcctcagattaccaggatgtggaatgaataagaaggggtctgggcatttatcacttgtttatttctttctcagtcttgtggtgaaataacaaaagtctcattgttcctttcaggagcagccacactggagaatcattcattcttgtaagaaattttgcttttcctttagtcagaatgctgagatagagaaggaaaatgcaatctaaaaatggtgaaaatggctaaattggtaaaccagtgacccatggggattttcttcaattttaataattgtggtaaaatacacataaaatttactatcgtaaatcttttttttttttttttttttttgacagggtctcactctgttgctcaggctggagtgcagtggcgagatccacctcccgggttcgagtgatcctcccgcctcagccgccagagtaggtgggactacaggcgtgtgccaccatgcccggttaatgtttttgtagagacagggtttcaccatgttgcccaggctggtgtcacactcctgggctcaagcaatccaccctccttggcttcccaaagtgctgggattataggcatgaggcaccatgcccagcccaagcatgtttaaatatacagttcagtagcattaaatattctggccaggtgtggtggcacacacctgtaatcccagtactttgggaggccagggcaggatgatcacttgagcccaggggttcaacaccagcctgggcaacacagcagtacctggcctctacaaataataataattagccaggcgtggtggtgtgcacctgtggtcttagctgctttggtgcctggggtgggaggatcacttgagcccagacagttaaggctgcagtgagctatgatcacaaaactgcactccagcctgggcaacagagtgagatcccatctccaaaaagaaaacgtgtaatatgctcccatctacctccagaattaattttatgttgtaaactgaaactgtataaacattaaacaataactctcacctcctccagtctctggcatccaccattctactttctgtatcattttgactactctaagtacccaatataagtggaatcatacagcatttgtcttttcatgactggcttatttcacttagcgtaatatactcaaggttcatctatgtcgtagcatgtgtcagaatttccttctttcgtaatgctttgtgtgtatataccacatttagattatccattcatctgtcaatagacacttgcagtacttccacattttagctattgtgaataatgctgcttataaacatggatatgatggttaattttatatgtcaacttgactgggctaagagatgcccagatacatggcaaaacagtatttctaggtatgtctgtgatgatgtttccagaagagaatagcatgtgaattggtaaagaagatcactctcaccaatgtgggtgggcattatccattccactgagggcctgaatagaacaaaaagacagaggaagggcaaattcactctccctgtttgaactgggacatctgtcttctcctgcccttggacataagcattcttggttctgccttctgactcagaccctgtacttttaccattggcatatatttacacacacacacacacacacacacacacacacacggatctgtttcattggagaaccctaatacaattgatgtataaatatctctttaagaccccatttcagttcttttgcatatatagccagaagtcgagttgctggatcatatggtaattctgtttaatttttagagaaactgccctattgtacatttgcaatagtgcacaagggttccaatttctccacatcctcaccaacattcattattttctgttttagttttgatagtagccatcctaatgggtgtgaggcagtatctctttgtagttttgatttatatttctctaatgattagtgatgttgagcatcttttctttctttccatctcaccacatcactatgggcctatttactgtagttcctcatagccagtacatcatgtccaccttttaacaagaaattacaaggcacactaaagggcaaaacccacaaaatttgaagagactgaacaagcaagcatcagaatcagagtcaaatatggcaggaatgtcataattatcagaccaggaattttttaaactatgattaatatgctaatggctttaatgtaaaaagtagacaacatgcaatgacagatgtatatcataaggaaaaatatggaaattctaagacagaataaaaaagaaatgctagagatcaaaacactgtaacagagatgaagaatgtctttgatgggctcattggttgatgagacatggctgaggaaagaatctctgagcttgaggacatgacaatagaaacttccaatcaaaactgaaaagcaaagagaaaaaaagactgaaaaaaaaaaaaacaccaacaacaacggcagaggctatgcatgggcccagaatgtccaaaaactgtggaacaacaactacaaaagttgtaacatacacataatggaaatgccagaagaagaatgcagaaatgaataggagcaaatttttaaagcaataatgactgagaatttcccccaaattaatgtcagacaccagacaccataccacagattcaggaagctcagagaataccaaagaagatggatgcagctgggcgcggtggctcacgcctgtaatcccagcactttgggaggccgaggcgggcagatcacgaggtcaggagatcgagaccatcctggctaacatggtgaaaccccatctttactaaaaaatacaaaaaaaattagccagctgtggtggcgggtgcctgtagtcccagctattcaggaggctgaggcaggagaatggcgtgaacccaagaggtggagcttgcagtgagccgagttcgcgccactgcactccagcctgggtgacagggcgagattctgtctcaaaaaaaaaaaaaaaaaaaaaaagatagatgcaaacgagcaaacaaataaaaaaaccctacacctaggcatattatattcaaactccagaaaatcaaagacaaaaaatgttgtaagaaaccagatggggaaaaacactttatccatagaggagcaaagataaaaattacatccaacttcgcctcagaaaccatgcaaacaagaagagagtgcactgacatatttaaagtgttgagagaaagaaaaaacagtcaacctaaaattctgaactctgtgaaagtatccttcaaaaatgaaggagaaataaaaactttctcagacaataaaaattaaggaatttattgacagtagacctgcctttcaataaatatccaaagaagttgttcagagagaaggaaattgaatctacaaaggatacgcattacagaatgaataaatgaaaagaacatcagccacagaaacagcactaaacaaccaagtagactgaatgacttagccactttgatgcttaccagtctctgctgttggtgccccaattcttacaaaatggatgtatgaaaggaggagccatggcagaggctatgcatgggcccaacatcatggactcatcaatacagatctagctactgatgttgttaatgttcaacttgccagtaacagagaccaaagctaaggctctgatatgtcaccatttctcaagaaaatcattcagttgcttggtgagcctcagtaaacaccaccattcaaggcctcacagaatatttgatcttacataacactgcatcagaccaagagacctactttaaagcaagaagatacatgaccatggaatccactacccagaagctacccacttgatagagtggtaggacagcttgttgaaggcacagctgaggcactagcttagacataatacctaaggacgaggcaccatcctgcaggatgcagtatatactctagatcaatggccatcgtttagtggggtgtgtcccgaagtaaaatatatggttttggaaaacaaggagtgtaagtaggagcagcctcacactaccattactcccagtgacccaattagggaaactatgcctcttatcccaactctgggctctgagagtttagaagtactggttcttaaaaggggaatatgtccgccagtggacacaccaagagtctcattaaacttgaaactatggttgccatcatattacttcagatcactattaagagaccaagaggtaaggaaaagagtcactatcctggcaagcgtaaccgatcctgatcatcaggaggaagggctgacattacacaatggagacagaggagaatatatttggcagccaggtcatctgcctgggtatctcttagtattcccttgttcaatgttgatgataaatggacaagtacagtcatggcttacaaagggcatgatgaccagataccttatctggtaacccacttggagcagcagaagtatgaattgagagggtggtggggggagggatctagaatgggtagtagaaggggaagatgatgagtaccagttgcagactcaagaaaagctaaagcagcaggagttgtgctgtgttccaaacctttctcttttgtttccccaggaaagggagcccatcagaatcctgaaggaaccattccagaacttatgaagcaaatgaatctgagcagcagaaagggtggaccacagtggaggctggtgtccagattcaccgcttcaggactaaagcacttatttcctaagctgctgggtgtgctgacagctgacaactctaatctgaattcctctctgagaaccaattttggctgaagtcagtcaccacatccaaactcatgccttattcctggtaaaggtgggactatataggtccagacaacttgcctcaatagagaacatctctgcagagccatcctagcttgagctccctgtgggactgacctttattcagactgtatcacctcaacttcttttacccaatcctgcttccttcactcccccatgggtgttgatccagaggatccccctcctataaactttctgcatgcaagaaaaaaaagagagaaaaaaggagaaaaaagcagacaataatttttattcatgtgcttaaaaagttgtaaaatcacccaaggaagcacataagttgtcagtatgtgaacaatgttggaaacattttattttgtctgatttcctttgggagaattcattgccagctataaatctgtggaaacgctgccacacaatcttagcacacaagattggcagaaaatcgcttagaaacactgaaaacatgtgacaaagtgctttccgtgaaaagggtggatgcgaagcagtaaggacccccttcatgaagcacgcggtcaccctccagccaccagaaccagaggaacgctgtggtaactgagggaaaacgcatctaggcacacgtcacggtggcaccttccagcaggtccccggggttgtgcccctggagctctgacaaagagtgtggcccggaaatgtgatgtttggactgcaagttttggtgagaaataacaatgcatcaggttgcagacaaagcagaccctgctctgtgcgtttatgggagccgcgcccaacaggaaccacagggaatgatcgaaaggagagggacggacacaaacagacacaccagagagaggttctcaggaggaggctctgtggcctccagaccacgtcaaagccaaggcagaaaggatgaactgaggaaaggaggaaaatttccccttaaggaaggtaaaatccagaagggatccctaaaatggtgagcagtttaaacctagcagttttgcattaattcacataaagtataatgaaaactgttggacacacaaggagagactggccaatctatagtcacagaggaagaccttcacaccccttcacaggatctcgcagcagattggctgaaaagtctccttgaaactgcagacctctctcaaggagacccactgagttgggcaaaggtggggccgacttaattcttgcctccctgctctcccacgtagccctgcatttcactccattccagggtttctgggacacccgagaaagcacgtagtccagggagcacgtctgccaactgaaggccttgacaaatgactttctgtactggctgagggccagggcccagcgtactgataaggaagctcttccagaaaaaagttgggacaaaggcatattagtgagtggacacaaactagaaaaatctccaagtaatacgttaatgccaacagaaagcatccatcttgaaggaagcacaaaccaacaacacatataaaaatgactctggcaattcacatcagctagcctctgcataggccatcgcagtactggcaagacatgagctaagtggctacagcagcagggagagaattaatgcatggacccaaaagcgtggcttcccactgactaaggctgatctagctactgttgccaccaaagtccaacctgccagcaacaaaaatcaatgctgagctcccaatatgccatattgggcccaacccctgggcccctgaccagtactggtctgtggcctgttaggaatggggtcacatagcaggaagtgagcagcaggcagggagcaaagcttcatctgtatttacagcggctccccatcacttgcattaccgcctgggctctgcctcctgtgagatcagctgctgcattagattctcataggagtgcgaatgctactgtgaactgcatatgcaagggatctaggttttgtgctccttatgagaacctaactaatgccgcatgatctgaggcggacagtttcatgccgtaaccattcccaacaaccccaaagtctctggaaaaattatcttccacgaaaccagtccctggtgccaaaaaggttggggattgctgcaatatggtattgtccatcacagagacaaaccagcttctcggtggccagacacactgaactccttccatcctagaaaggacaggacttcattgtgatacctaatcttggcgtaacttagcctttcctcccttcagggccttagccagcaccactatctgaaatcttacagaggatttgattcactgatgtggaattccatatagcaccgtgtagacctggggaatcattgtacagcaaaagagatgagggagtgggtccacaaccaggcacaggtagaactccagcttggaggcaggtctctgtgaggatggagggccagcctccaaggtgctgtatatgtatgaattcaaagatgattctgtgtccccactaagaagattacatggggtttgggaatcaaagagtggcagcaaaagaactctgattagcacccccgccaatgagccacgtggggagtctctgccgcccctccctgcagctctgggacccgcagcagaaaggcccctgcagcagaaaggcaagagtatacggcgggtgccacctggccccgccaggctaacccagggcaatgcagagcagtggcagggagagggggtgagggggaagaatggcaggggctgggggtgccatcacgcccagggcgcgggcaggagcgtgcagctgagccctgaacccacgacgacctggagctgagcagcaagagggtgaggggcgcccggatggcagtctaggaaagaactccccagtcccagccattgggtgtgggaagtcagccttcacctccgctgaggtgtgcgccgggattgccccagaggaatgttgcctgtgggggccacgcaccttccttcccaagacagaccacgcccctctaccagggcatgccccgcccatttccaggacaggccccaccccctctctgggcagaccacgcctcttcccagcgccgactctgccctgtcccaggatggacagcacttcatgagtgctcagtgcagggacacagaggcctggacatgttggtccaacctggaaggttcattccagctccagagctccctgtaagatccagcaaggctgtcctggagcctacccggcagcgcgcttctccctctgcctatccctgattcctcaggtgttgatcccaagaacactccaaataaaattcctgcatgttaatcttcatctcagagtctacatctagggaacacaaccagtaacattaatttttttttttttttttttgagacggagtctcgctctgtcgcccaggccggactgcggactgcagtggcgcaatctcggctcactgcaagaacattaatttatatttaaacatactctaatgtcatctacctctaaaaatttccatggcactagtcttaacataagcctatgtagttttcagtcatttaacattattatgcccttccacattcaccaactcatccctagtttgctacctttctcctttttccatatcatatccttggttccactacgtctatcctaccccctctctgtgcagtttccattgatttctaaggtatttcaacataagttaccacagtgctttcactttaaatgtttctgattaaaggccagacccaatggctcacatctgtaatcccagcactttgggaggccgaggcgggaggatcacctgaggtcaggagttcgacaccagccgggccaacatgaagaaaccctgtctactaaaaatacaaaaattagctgggcgtggtggggcatgcctgtaatgccagctactcaggaggctgaggcaggagaatcgcttgaacacgggaggcagaggttgcagtgagccgagatcatgccactgcactccagcctgggggatagagttagactctgtctcaaaaaataaataaataaataaataaataaatgtttctgactaaaatgaagatataagacacatataaaatatgttatagagcaatagattggaagatcagagagggaacaggatcaagagcacacagaaacactttttccctctctgagggaagagtgaaaacacataattgatggagaaacaagattgtgagacagaaaaacaaaaaggcctaggccctaggtcaagtatatgtgattcaggacaggactctattcaaagggaataactagatgttcctaagagcattaacaccctccaagtgtgtgattcagttctgagatgaacctattacaggacaatatccagctccccagcctgagacctttgccatttgagtgaatattttccacgctggcagaaacatgtgatttatttgcctgtctcactttcaggcaaatctgcatagtaaatgacaaaatgttccagggttcctgggttttactccttcctaacttttgtggggttttgtttgtgtatttcctttgggattcaatatagaaatcctgccaaatatatttggcaaccattgtccttgacatgaactgttctttcacattttatctaaaactaatcggaaaacctattatattccctgacctgtggttagaagaaactgagcagctgcgggaacagataatataaaactgaattttcccagctgtttatttcaaaccttggcagaggctgtcaggatgtgtccagagtcagcttatcctgttaatcagcatcaaaataatctaaagtataaaagggtttcattaaaataaaaattctatcaacttttttctggtaaatacatgtgactgcctatacaataacagaaagctagataataaattaatgatgtattccattcaattcaattttatactcaaactattattctctgtgcctcaggctgcatgctagatggacactaatatacacagtgtattaagtaaaattatctcaatattaattgttaacagggctaactttaatggataaatggttgtttagttagatgccaggctactgacaacctgggcctctactttcaaggtcactaacattgctcatctgcaggctatataggctgtagaacgaacttggatcccctcctcacaccatataccaaaattaactccaagtggatcaatgacctcaatgtaagaactaaaactataaaagtctcaaaagaaaatataggtttaaatcttagtgatctttgatttgacattgatttcttagatatgacaacaaaaatacaagcaaccaaaggggtaaaataaataaatattggatttcatcaaaatgaaaaactttgtgcatcacaggatactattaggaaagtgaaaatactacccacagaatgggaaaaaatattttcatgtcatagctctgataagggtataatattaagaataaataaagaacttatacaactcagtactaaaaaacaaataatccaattaaaaacacgcaaagcatttaaatagacatttctccaaaggagatacacaaatggtcaataaacacatgaaaagactctcaacaacgtaagtcatcagggaaatgcaaatccaaactacaatgagatatcactttatccacactaggatgagtataattaaaaagacagacagtaacaagtgttgataagaatatggaaaaattggaacactcatactttggtagtgaaaatgtaaaatggtgcagctgctttgaaaaagtctggcagttcctctaaaagttaaacatagaattaccatgtgacctagcaattatattcctaagtatattccgaagagaaataaaagcatatgtacacaaagacttgtacatgaatgttctatagcagcattattcataatagccaaaaggggaaacaatccaaaagtccatcaacagatgaatggataaacaaaatgtggtctatccatacaatggagtattattcagccataaaaaggagttaaattctgatacatactacaacatggaagatttttttaaattaaaaaatgaaaatagtttcattcttactatatctttattttcttattttaactcctctatcattctgcaaaaatggaagaatcttgaaaacatgctaagcaaaagatgctagacacaaaaggccacatattttatcccttcatttacatgaaatatccagaataggcaaaaccacagtgacggaaagtaggttaatggttgccaggggctggggaaaggaagaaaattagaagtgactgtttaatgattacagggtttctttttgaggtgatgaaaatattctggaattaaataaagatgatagttgtacactttacggattcactaaaaaccactgaattgtacactttcaaatggtgaattttatgatatgtaaagtatatgtcaataaaaatgtggagatttaggaaaggaaaagaatctccacactgaaaataagtgatttttacagtatgtaaatcatacctccaaggagtgaaaaaatggtaaggaaatattctgaactttatactattaaattcaacagctcagatggaatttcttttctttttttgagacagagccttgctttgttgctcaggctggagtgcagtagcatgatccatagttaattgcagccttgaactcttgggctcaagtgatcctcctgcctcagccttccaagtagctgggactacaggcatatgttaccacacttggctaatgaaaaaaaattctgtagaagtcaagtcttgttatgttgcccaggctgatctcaaactcctggcctagagcaatcctgctgcctcctcccaaagtgttggggttacaggtgtgagccaccatgcccagtctcaaatggaatttcttaaaagaaattattaaaatttatcctataagaaatagaaaattcaaatagccctttacctattaaaaatagaattcacaattaagacccttaaaaaaaaaaccaaaccaaaacaaaaaacactgggataagatgatttccctggtgaataaacatttaaaaaagaaatgataccaattctacacaaactctttcattaaatagaagagtgaacacgtctcaactcattttataagaatagtcagccgggcgcggtggctcacgcttgtaatcccagcactttgggaggccgaggtgggcggatcatgaggtcaggagatcgagactatcctggctaacacggtgaaaccccgtctctactatcagtataaaaaattagccaggcgtggtggcgggcgcctgtcgtcccagctactcgggaggctgaggcaggagaatggcgtgaacccgggaggcggagcttgcagtgagccgagatcgcaccactgcactccagcctgggtgacagagcgagactccgtctcaaaaaaaaaaaaaaaaaaaaaaagaatagtcttactctttgatatggtttggctgtgtccccacctaaatctcatcttgaattgtagctcccacaatccccatgtgctgtgagagggaccaggtgggaggtaattgaatcatggcagtggggttttcccatgctgttcacattatagtgaataagtctcatgagggctgatggttttataaagggcagttctcctgtacaatgctctcttgtctgccaccatgccatataagatgtgtctttgctcctcctttgccttccaccatgattgtgaggcctccccagccatgtggaactgtgagtccattaaatctctttcctttataaattacccagtctcgggtatgtcctcatagcagcattagaacggactaataccactcttatatcaaaaccagacaatgacattataagaaaatcacagccaaatatccatcatgaacacagacgcaaaaactaaaaaaccaccatcaccaccaaaacccttaacaaaacagttttagttggccagggctgccataacaaaatactagagattgggtgacttaaacaacagaaacttattttctcacagttccggaggctggaaatccaatatcagggtgccagcacggtcagtttctagtggagccctcttcccagctggtagatggctgccttctcgctgtatgttcacatggcttttcctcagtgcatgagtgtagagagagaaccttctctcttcttatgaggccaccagtcctatcagattaggactccatccttatggcctcatttaaccttgtttacctcctaaaagccctatctccaaatataatcatcttgagagttaggacttcaacatatgaatttggggtggggggaggtggagacaattcagtccatagcgaaaatattaccaatgtaatatgtcacaaccaggtggattttttccctgggaatacatagctagttcctcattaaaaaatcaatcaaggtaattcaccataacagaataaacaagataaaccatatgaccatttgaatagatgcagaaaaagcatttgacaaaatctaatatcaaatcttgataaaaactctcacaccaagaatagaaggaaacttcctcaatttgacaaagggcatctatgaaaaaatttacaagtaattgtacttaatggtaaaataatgaatattttccctctgaaatcaggaagaagacaaggattctgctatcatcagttctatctaacattgtactggaggcccttgccagtacagtaaggcatgaaaaaaaaaataaaaagcatccagtttggaaaggaagaagcaaactgtctttatttgcagacaacattattgtatatgtagaaattctaaaagaagtgcaaaacgctactagagctaaaatgcaaattaacaagattagagtgaacaaggtcaatatacaaaaatcaattgaatttctatattttagtaacaaatgattggaaaacgaaaacaaataaaaatgatacaattaacaatagcatcgaatccctcaaaatacttggggatacaattaatataattcttgcaagaactactctgtaggctacaaaatatcctagagggaaattaaagaaaatttaaagaaacaaagccataccatgttgttgtattgaaagattcagtattgtttaaatgtcaattctccccaaattgatctacagattcaattcaattccagtcaaaatcccagttggctatttggtggagttggctagttgactataaaattaatacagaaatataaaagcctaaatatatcaaaagcaatttcaataaaaaagtaagttggaggttttagactgcctgatattaagacttactataaagttacaacaatcaaaacaatctggtactggcataagcacagatatacacatctatggaactagagaatccataaacagatttgcctatatacagtcatttaattttctacaaaggcaccaagggaattcaatagagaaagaaaagtcacaccatacagaaaatttaactcaaaatgtattataaacctaaatactaatgctaaaatgataaaagttctagaagaaaacagaagaaaggctttgtgaacttgaggtgggcaaagatttcctaggacaggggaaaaaaaagcatgaatcatagaagaagaaaagctaaattggacttaactacaactataaatttccactatttgaaagacaccatttggaaaatgaaaatgcaagccatagattggaaaaaaacattcaaaacaggtacctctgaatagtcttgtacccagaatatataaaaaattatcaaaactcaacaataacaagacaaacaacccaattaaaaactggcaaaccattatcctaagtgaattaacacaggaactgaaaaccaaataccatatgttctcacttagaagtgggagctaaatgatgagaacacatggacatagaataatagacactggagacgactagaggaaagagggaggaggaagggtagcaaggagtgaaaaaccacctattgggtactatgttcactacttcagtgacaggatcattcattcgtaacccaaacttcagcaccatgcaacatactcatgtaacaaacctgcacatgtacctcctcagtctaaaataaaagttgaaactacgtttaaaaacaaaggaccaatgatttgaatagacacttccaagaagatataggaatggctaattagcacatgcaaagatgctcaacatctttagtcatcagagacacgcaaattaaaagtataaccaggtgcagtggctcaagccgtaatcccaacattttgggaggccgaggcgggtggatcacttgaggccaggagtttgagaccagcctggccaacatggcaaaaccccgtctctaccaaaaatacaaaaattagctgggcacggtggcgtgtgaccatagtcctagctactcaggaggctgaggcatgagaattgcttgagcctaggaggcagatgttgagctgagattgcgccactgcactccagcctgtgtgatgggatgagattccatctcaaaaaaaaaaaaaagtatagtgagataccactgtgcagtcattaagtactggcaacatcaaatgttgtccaggatatattgcaactggaactctcatgcattgctggtgggagtatagaatggtacgttcaagaaatctgtctggcagtttctcttaaacatgcacttaccatatgatccagcaattccactcctagatatttaactaagataaatgaaaatagatgttcacacaaaacatgtggagcactgttcatagcaggtttatttgtatttgctcctaactggaaataatccaaaattatgatataatcccataatggagcagtaatcagcaataaaaaggatagaaatactttatacaacaacctgcatgaatttccaaatcatgatgctgaagaaaaaaagccatagaagaatacataccgtatgattccactgatgtaaaattctagaacatgtgaaaacaaatctgtaacttccagatagcagtttattggctgaggccaggtcagtgggagagactcattaaaaagttgcaggagggttgatgtaaatgcatgttgattagggtggtggttatgcaagtgtatgcatttgtcaaaactcatcaaactgcatatttaaaattgatgagcttcattgtatgtaaactatacctgtggcaggtaaaaatttggcccacatcacctttgctccttggtgtcatgtccaaaaatatattatgtggcaaattaaactttgcagatggaattaaggggctgattagctgaccttgagatggggagagtattctgaattacccaggtcggcccaatgtaatcacatgagtccttaaaagtaaaagagagaggcaaaaaaggccagagatatgcacggaaaattgaagtcagagcaattccaagcatgagagagtgttgatgcaccattgctggtagagggcactacatggaaagtgagagaaggaactgaatttgctaacattccaaatgagcctgtaagcagattctccccaagagctttcactaaggagtgcagccctattaaaaccttggtgttggccttgtatgaccctgcacagagtatccagctgagtccacctggacttctaactcacagaaactgtgagacagtaaatgggtctgtcataagctgatacatttgatgtagtttgttacacagcaataggaaattaacaggatattcaatgttgacccaaatactacaaactaacttgataaacaaatttaaaaagcaattaaaatcatacgtctagattatcaaagatgaaatcaaagaagatattacaaactattctgaaaaaaatgaaaagaaaacccttcatgctataccattttacaatgtatacttacatcaaaacattatcttgtacaccttaaatatatacaacttttatttgtcaattataccacaataaagctggggtggggtgggatagaattacctggggactaaatagtttgctgaggatggggcctaggaatgtaaattttaataagcttcccgagtgattcttatgcacactgaagtttgagaactagtgccttcatggacttcagctttggggtgagctttaagaaagtcagggtccagttaatgaatatgagagatactgcttttttttatttttttattttttgaaatggagtctcactctgtcacctaggctgagcacaatcttagctcactgccacctccgcctcctaggttcaagcaattctcctgcctcagcctcctcagtagctgggattacaggtgagcaccaccatgcccagctaattttttttttttttttggtagacacggagttttgccatgttggctaggctggtgtcaaactcctgacctcaggtgatctgcctgcctcggcctcccaaagtgctgggattacaggcatgaaccaccatacctggccgattgcttatttatatctccaagcttcactgatcagaaaatacttttcctgaaaagttatcctacagaaatcagatcatgttgagaggataagtctctggaatgttaataaaggtatatggagctagcatagttgaactgttcactttttgcataagaaatctcactgttcatgttttcccatcagacaaaataaaacagactgacgagttttatatattaatgtgtgaacagtgcatagctacatgccaataaagcagcacagttaatgaatcaatagcttctttttctgctcagtgaaaataaaaatgctttataccaactagaaaaaaaaaaaatccaaaagcccattctttgaaaagagcaccaccagcaacaaaatagacaagtcattggcaagcttattcaaggaaaaaaagataaatagcaaagatagaggaatttaggaataagaaagggcacataactacagataatgtggagtaaaagaatcatgagtgagtgctacatgcaacactgtggcaacaaaattgaaaaaataaataaagttacttcctagaaaggtatataattattggaagttgaaacttgaattgactgattatcatagaagagcctggaggggtgattaaagatattgcaaatgccactaggaccaaatggattcataagtgagtctcacctaacttttagacaatggataattcaaatgttacttaagctattctaagcaatagaaaaagatggagtactcatcaattcatttgataaagccaacaaaactttgtttattattattagtaggttgagtagtgaaaatctactaagaatagtctaaagaaatagtacatagaacccactaatgatcaaattccatgaatagtagattttactccaagaatgtaagggtatttagtgtcaggacatctatgaacataatttgttcatcagcatatcaaagaagacaattcagatgataccagctgctgaaaacttatttatgataaacattttgtggcaaatgagaatagaataaacaccatttacaaaaaccaaaacagcaaatgttactctaaatagcaaaatacaaaaattatttcaagtaaaatcatagagtagaaggaatgttcactttcattgttattatttaacatttgctcttgttttctaataaattcaataagataagaaaatgaaataactggctataaatattggaaatgagctaaaatctgtctcatttaacttatgatatgattcaatactcacagagactttagggtaaaattactagaattaataggcaaatttggtaaggtagctagatttaagatgaatatacaatggctgggtgcggtggctcaaacctgtaatcctagctctttgggaggctgaggtggggggaatgcttgagctcaggagttgaaaaccagcctgggtaacatggcaaaaacccatctctaaaaaatatacaaaaattttccgggcatggtggcctgctcctgtagtcccagctacttggggggctgatatacaggagaattgcttgaatccaggaggttgaggctgcagtaaggtgagatcaccccactgcactccagcctgggtgacaaaatgagacccaggctcaaaagaaaaagctgaaaatacacaaaccaatagcttatctctatttggtactaagcactcataaatggaaataggagaaaactatcttattaacaatagcatcacacttataaaatacacagagataaatgtaataagaaaaatatttaaatttattacattaataaaattaaggtctgagtttaatgaaattgcagttagaatcacaacagggcttggatctttttaatttgaaaaatatcttaacagttttatgtggaagaataaagtgtctaagaatagctaagaaaggtacaaaaagaatagtgaggattgctttcacccaccagatatcagaagatatcataggctcactgtaatcaaatcactatggtactggcatagcaagataatagtagattagtgaaacagcctaatgaatccagaaatatatgctaatatatatgagaactttatatgatgaatgtgttgattcaaatcagtggcaaaaggtgccatcacaataggctattgatctggatggaaataaaactagacaaatccctctctcatgccatatgacaaaagtaattagcagataattgaagcaatgcatataaaaagcgaaacagtaaacatcttgcaagaaaatctgggagattacacgtacaatcttgaggtgtgggaaacatttttaaccaaccttgccgactctgaagatatgaaagaaaagatatctctgattataaaaattaaaaactgttttggtaaaagttataagaaagtcaacagacaaacaatagatcttggggaaaactgcaatatacatgacaaagagttaatatttgtaataataaaagggttctcataatttttttaaatgaaagagtccaaagaataatgggcaaatcatatgactaattaaatcccccaaataaatccaatagccaacaagcatttaaaaagatgctcaacttattagaaataaaaataacacaatgaaagtaatgatgcaatatcactctacacctgtaaaattggcaaattttaaaaacaggataaaacttatcgctatgtgaatgcagagagaaggccattttcatacttcgatggtagaaatgtttgaaaagttctgacctctttggaaattaaaacttagaaggaaacattcccttcgttccattaatattcctcttgcaagtttgttcaacagaagtaaaagcaccagtatgtaatgatataggatatagtagccaaaaactggaataaagtgaacatattgactaaattgtgatacagccataccatagaatcttatatagccaataaaaataatgaattaaagctataccaattgacttagagttctagtacgtgttaatgagtgagaaatgtgtgtataatgtcccaattttataaaacaaataatgtccaagaaaacctttgtgtgtgtgtatgtgtatgtgaatatatattatcatactggggttacctagctgaggtgggggagaaggggactgatgtggaaagagggtggggagccaaacagaaagaaccaaaaagaatataaagtatgtacaacatgaccacatttaatgtttacacagccacaatctatgtattatatttaaatctttataatacacatttaaagaagacaaaaaaataaaataaatgatttcagcattcaactcaagaagcaaaaatctaacaacaaaatgaaccaaaggaaattagaaggaaggaataaatcaatgaaagtagaagcagaaactgatgcaacagaaagaaaaaagagattgataaatcaaaccaaaagaaaattcttgacaagaccaataaaatcaagaaaactcctggaaatattatttttaaaagagaggaagagaacatatacaacataaggaatgaaaaagaaaatataactacagacacagaacagtttaacaaaatcacaggagactcttacataacttgataccaatacattatcaaatctagggacagtagattgctttctatgaaagtatagaccaaaatataccaatatttactgaagaagaggtagaaaaatctgaatcaactgatgaccatagacaatattgataaagttatttaatactctgcctaaatgcaccagaacccccaaaacacgaaaagcttctgaactcaaggctcatattatccttacacccaaagtaggaaaagatattataaaaacacacattgcatgtacacacaagagaaccagacatgaaacttgtgtgtgatattgattggatttcattgccttgattctctctatggaagcttgggcaggcagagggaagttttgtctttgtcccttcaccctccctctactccagtctctagattctggaggagcagcatatgacgaagagaagcaatggacaaaacagaacaaaatatcaacaaataggtcagacctatgaaaagaattggcagttagcatttctgctaataacacagatgtgtgcacaccttacccagaaatgtttctttggggcccaggtagcatcacaaccatcctaacccgatgtctgcaccttcctccaagcagacttacatccccacaatcctggccccgatcagaccctacaggacatgcctttaccttgcgtccacaggcagctcaccgagatcactttgcatatagtcccatgacagttccactgcacccaggtagtatcttctggtggcactaaagcagaatcgcaaaaggcacagaaagaagcaggtggagagctctatttgcatgacttattgctacaaatgttcaactggagaagcaaaaggttaattcttctctaaaatatctttagctcccaggaggggaaaaaagtaaaatttctgatttaatgaaaagtcccaatttctttgcagagcattttaaggaactttacccactggatgtgctcagcactaagcagtaaccgataggattgcttcctttttatcagtgggaagcagccacaggaagaactgaagtagcaaaagggaggctgctaaacttaacccattcacttctgagagcagtaggggcataagtctgctttaatcagaacctttaaggaaaggaggagagggatggagaagtcaaagtgaacaggagctttaatttgtgctcctattcctagcctactccaaccctcttcctgagtggcagcagcaagagaagttctggatgttgtcgaagattctagaattcacttgcactagcaagagtaaccagcaacctgttagtctctctgcttttgcccttgcccctcacactgctgccagtatgaggaatttatagtttttaaaactgtagttttacatataacatgaggttaggcaactattgttttaaaaactataatttatagttataatttaaaactataaagcgagtcctgtcactcctcttctcagaatcctccaatggcttctgacctccatcagggtaaaaccctacatctttaccatggcctaggtcctagagcatcccacatggtctgcatgccctttctcctgacctctgtagtctcatctcactctggttatactggtctccttactcttccctaaaatatcaagcacactcatgcccctggacctcaacacttgctatttcttttacccaaaacacctttcccccagatttccacgtagttccactcccacaactccttcacatttcagctccaatcttccctgttgaatgaggtttaaatatggaacaccacatttatgttgtaagctctttacccccacctgcatcactgatatccctcttggcttcatttttctcaatagcactcataaccacctggcatttattcatttatttattttgttttgtttttaacctaacacttttccaggctgtttacatttggcccaggtataggatatatctctttacatcagaatgtagccatggtgagctcaaacaccctactcaggttaatgtttattagggagagtgagggcccctgcaggggcctcaaagtgtaagagattatgagaagaaacttgatcagggttgctataaaaatgttatcattgagctcagttctgcacaaacaagaatgtgttagggagcaattggtatattgtcgactggtttggaaacaggcagcaagaagcccctttgataaacactcctctctgacaggtacaaggatgcagagatgacagctgacactatatgccaggaactgttctaggtgcttttaaatacaggtactattcttaccttcattttatgggtgatgaaactgaagcacggagaggttaggcaacttctccatggccacacagcttgtgagtggtagcattcaaacccatgtactctggctccagaagtcatgctcctaaccactatgctatacttctatgcctcagaaatgaagaaatcccagttcccaaccccctgggaatgacagtccaatggaggagacagaaaagtagacagttacagtacagggtgataaattcactgccaggtgctacacataggctatctgatttaatcctcatgacaacaccgcaaagtggatacagataaagtaactgaggtacagagaggttaaatggcttgcctacagccacataactacccatttgtcctagacagatattgtcctaggcactgggtacacattgatgaaaaatataagcaactgaaagagggatgataagcaataattacaatacatgagtacattatacagtatgttagaaggtaaaataagtgctgtgcaaaaaagagaagtggggtaagggggagtaagggtggaccaggttgcaattttaaaggaggttagtcatggaaagtttcactaaggttgcatttcagcaaagggacattgacttctacactgagggcaatggggagacacggccgggttgtgagtagaggagggtggtgatcagaattatcttttaggctgatctttctgatcactgtagataaaacaaactctagcaggataagggtagaaggagggtggcctgttaaccgggggtgagaaatggtggcggcttgggctatgatggtaccactggagagggtgaaaaatggctggattcattgtgagggtaacgtttgtgggaactgctgatgaattttggatctgtgggctttgagaaggaaaaatttggaacaccaagttttttggaataaagttgactaactgggatggggatgactgcatgagtagcttaggggcggggcacactgttaaagggctcctcaggcactgcaggcatagaagctcctttctttcccagtgcttctcttatagcgattacaatgttttaaaaatgtgtcttccagacaaatacagtacaatccaacatgtttgaggttctacagttaacagattgtataattaataatctgggtgggaatgttaatcaggaatgaaatacaatttaaaaattaacaaagtaatgagtcagaggctatattgatagaagcactttttaaggaatagcattccctggcccaagggcttagttgattgaaaattttatctattattgctaaattttaaatcaaaatatggccgggcacggtggctcacacctgtaatcccagcactttgggaggctgaggcgggcagatcacgaggtcaggagatctagaccatcctagctaacaagatgaaactcctcctctactaaaaatacaaaaaattagccgggcatggtggcacgtgcctgtagtcccagctacttgggaggctgaggcaggagaatcgcttgaacccgggaggtggagcttgcagtgagccgagatcgcgccactgcactccagcctgggcaacaagagcgagactctgtctcaaaaataaaataaataaataaataaataaataatcaaaatagaccccattaccaaattttcatgttttcaaggattctctaaaacctacaatattatcaattacatattcacaaataattactgaatacaatatggtatgtggtaaagtacaaaggagtactgtggccatttgtgataaatagaaatcaaattggaaatcttcatagataacgtattttttcttttttttttggagacgcagtctcactctgtcgcccaggctggagtgcagtgtcgcgatctcggctcactgcaagctccgcctcccgggttcacgccattctcctgcctcagcctcccgagtagctgggactacaggcggccgccaccatgcccggctaattttttgtatttttagtagagacggggtttcaccatgttagccaggatggcctcgatctcctgaccgcgtgatccgcccgcctcggcctccgaaactgctgaaattacaggcgtgagccaccgcgcccggccagataaggtatatttttattccttttatttttactcaactcctatggtgccacaaaatcctatattaagcagtataattgaaaagaaaaagaaaacaatagcacaatgattataaagaaaatagcctgagttaacttcatttgtgtcactcctaaagcagtggatcagatgtcaatgtttattatcattcactaattacatttatgaataatttttaaaagtaaaggaaaagactggctgttttaactaacataatagaaactgttgctggattttctgttgaaggtatattttgaagtgagttttattaagtataactcgcatgtaaaattcaaaagaaaaattaaatacataaataaaatgtgtcttcctccactaaaagagtaggacacatcgcagaagccgataaatatttgttcaatgtttacatgaacaaacacggtcactcagccgtctttattttcagtgagtcataggtaaaatattcttcaccaggcgaggattgagtcgcagtcgcgtcaggaactcgcctccaggtactgagcgagcgagccccgacggccgcggtgggtggaggggggaaagtgggggagagtggggcgggagtagagggagagcgagggagggagcctcacccccgggacgctttctgcgcacgcgcatctcggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggtaagggcgggcgcgcgcgcggccggcgccgcggggagccgccttcctgggctccggaaggggaagggctccgcgcccgccagtcgcgaccgagctccccggggagtccaagcggcgcggggacggggagggcgctcggggatcgcccctggctcagccgctcccagggtccggccaaggtcacgcgcgtgtctggggcctaaccaccctggggtgtcgtctccagtggagctcacccagccttccggcgccgcccccggcgcagaagcccgaagacattctgtccccgttctcggaagcggtctggcttctttgtccctttggacgttcatctcaaatgcctcgtggcgtcattctgtgtacaaggcacctccccaactgctttattgttggttttgaaaaactagcacatatgggatggtacttaggaatagccttctgtttagtcggcatagtcaaagattccgtgtaattcgcagtggagcacgtctttaagttatgcgtcttaccctattttgaatgtttaggttgtatttaatttagtactgactcacgggatcccattgctaaacagagccatcattgaaaactcaatcatataaacgtaaaattacgtaaattatgttaaaaacaaaggcagtgaaaatactaaaaactcatcacttttattatttaccatgttttattgttactttacttttgaggttatttatacatctattgtatctttgtggaggagatactatactatggtgctctactgtgcgtctcttcccatctctgggttcagtagtttcacaattcagtaatgtcatgctcacgatgaatgaatacgcaatggaaattggctacactacaaatcagcccttgcctaaagccgactgttaagcatttcaccagcacgccgctaaattttagatgactctgggaaggtggaatgtgcaatgtgataattatgtattttcctgcagagcagactgctcttatagacttttataagagcagactgctcttatagacttttataagagcagactgctcttataggttgatcaggtatttgcacctaggaaattgttgtgagaaattttgaggttaagatgagtttcaattgttatcacagtgatgatcacataataactgtgatcattgattttgtgggctcataaacgaagctattggctgacttttgtctgtcatagtgcttagcagtgtttgaccaatgactgaccaaatatctcgcatttaatctaccttcccccctactcccttttttagggactagatctgtcattcaggctacagcacagtggcacaatcatagctcactgcagccccagtggagccacctgttgatctaaggggcttggtcaaattacgttaaaactgtaatgttttgttgttacattagaaaaataaattatttaactacttgagaggccatggagtacccaggtactcagacatccatattttgttctgctaaatgggcgtctgtgatgtatcctgaatgaattcttgaattatattttgtgtatggtttaaggtagaggttgagagtagttttttttgaaacacaaatatatagtagttctaacatcatttgttgtttccttcattgagttaccttggtgctaagttattaaaaatcaaatgactatatgtgtggatctatttctggattctggattctcttccattgctatatttgggtatccttgggtcagtttgacagtgttgaatgtcattgctttataagccttgaaattaagatagttgtatattatactgtagctttataatgagccttgaaattccttgaaccctcctctttcccttgcccgcctccgcccccaggattattgtggcagtttgtattttcctgattgcagcaatattttccattccttatggtctttttcctagtgactttgacactcctcccacccaggggtgggatctatattccctcttcatgaatctggatgggagtttgtgactgactgcctgttcctacagaatgcagtggaagttaacactgcatttgctctctccctttcttgggactttcacctcctgaactcagctcctatgctgtaaggaagcctagactgactcacatagagtagcagcctatctatctgtgtgagtgtagagtcttcagacccagcctgtaagtcttctggctaaagcctcagacatgaaacaaagacaaaccacagtgctgtggctgaattcctgatccacaaaatctgagagcataatatatgattgttttgcttcatgaagttttggagtaatttgtagtacagccgaagtaactggaacactgctgggtttttttgtatcttcatatgaattttagaaccagtttgtcaattacataaaaacctacttttttgccgggcgtggtggctcactcctgtaatcccagcactttgggaggctgaggcaggcggatcacctgaggtcgggagtttgagatcagcctgaccaacatggagaaaccctgtctctactaaaaatacaaaaaattagccaggcgtggtggtgcatgcctgtaatcccagctacttgggaggctgaggcaggagaatcacttgaacctgggaggaggaggttgtggtgagccgagattgtcattgcactccagcctgggcaaaaagagcaaaactctatctcaaaaaaaaaaaaaaaaagaaaaaagaaaaaacctactttttaattgagattgtattgaatatatagatcaatatatggagagaatgaacatcttaaaaatattgagtcttgcaaaacataaacagtatatcactgttattttaggtcatcttcaatttcttggcagtgttttgtagtttgcagtgttttctagtttacagtgaacaggtcttgtgcatctttcattgaatttactacaacataatttttgcaattaaaattattttgttttccaattcatcatttctaatacacaaaaattcaaatgactttttaatattggtcttataatgtgtgaccttgcttctggtacctttttgtagatttttctgggttttctatatacaccgttatattatctgccaatgaagacagaattattgttgtacctcctttctaatctctttgacttttatttcttttcttttgttgcactggctaggaactccagtacagtgctgggcgaggtggctcacacttgtaatcccagcactttgggaggctaaggagggaggatcacttggggccaggagttccagaccagcctaggcaacaaagtgagacctcctgtctacaaaaaaaaaaaaaaaaaaaaaaaaatcagttggtcatagtggtgcacagctgtagtccagctactggggaggctgaggtgggaggattgcttgagcccagaagtttgaagttgcagtaatctgtgatagtgccactgcactccaatgtgggtgatagagtgagaccctgtctcaaaacaaaacaaaaaacagttgaatagattttagggaaagaaaagtgttccatatttcaccattaagtatgatgttagttgtatatttttcatagatgtcctatatcagattgaagaaatccctttctattcctattttctactttttttttttttttttttgagatggagtttcgctcttgttgcccaggaaaatgggcagtggtctgatctcggctcactgcaacctccgcctcccaggttcaagcaattctcccatctcagcctcctgagtagctgggattacaggcgcctgccactatgcccggctaatttttggtatttttagtagagacggggttttaccatgttggccaggctggtctcgaactcctgacctcaggtgatccacccgcctcggcctcccaaagtgcttggattataggcatgagccaccacgcccagcccctattttctactttttattctgatttttttctttgattttaaagtataaaatttctgtaattattatttttttacagtaagtattcatttagatttatccacctatttgcccattccagtgtctcattcctttctgcatttccatatttccatgtggcatcatttcttgtcggcctgaataacttttgtgtacctctttgaatattacttctatcccattctttctaatcttctggaactccaattacatatatgtttaatcttttgagcagtttttgatcattgttatttgcttacttcagcatcttgatcatcactggttctgtttctgtttctgtttctttttcttttttctttttgggactgagtctcgctgtgtcacccatgctggagtgcagtggtgcgatccttggctcactgcaaccttcgctacccgcgttcaagtgattttcctgtcccagcctcccgagtagctgggactacaggcacatgccaccacgcccagctaatttttgtatttttagtagaaacagggtttcaccatgttggccaggctggtcttgaactccagacttcaagtgatccgtcccccaggctttccaaagtgctgggatacaggcgtgagccaccgtgcctggcctgcttctatttcttttatttaaacaaattttgtttcctttatatggctttgcctttgcatgggtagtagtcattttctattgtttgttacattatgtgtgaaaagattgtacacactccatgccagatgaagttgatcatttgaggtcaattttacagtaaacagctttgaatagtacattgctgacatttcatatcagacatttcttagtgcggtgtgtttccagggaaacagggctgggtatagtaggggagcctgacattatcttcccacagagaaagggattgacattttgttaagtctttctccatgcttgggcaaatcatttaactttggaaccttcatttcattttttttttttttctgagacggagtttcactcttgttgcccaggctggagtgaagtggcgcgatctcggctcactgccacctccacctccccggttccagtgattctcctgcctcagcctcccaagtagctgtgattacaggcgcatgccaccatgcccagctaatttttgtagttttagtagagacgaggtttcaccatgttggccaggctggcctcaaactcctgacctcaggtgatctgcccaccttggcctcccaaggtgttgggattacaggcgtgagccaccacgcctggtgccttctttttttttttttttttttttttgagatggagtctcattcttgttgcgcaggctagagtgcagtggtgcgatcttggctcaccgcaacctctgcccctcaggttcaagtgattctcctcccgagtagctaggattacaggcatgtgccaccacccccggctaattttgtatttttagtagagatggggtttttccatgctggtcaggttggtcttgaactcccgacctcaggtgatccacctgcctccggcctcccaaagtgctgggattacaggtgtgagccaccatgcctggccttcatttcttaattataaaattgagttaataagtagtacctaccttattctgtggattaattagatgtacatgattaatgtttagcacattgcctggtaaatagtaagagctcaattaaacattaccctctcatcttcattatcactggagatccacgtagtacttagaaaatttgtggattactgaatagcattgagctacttctgaagagaaggggcaaatttgtttcatttgggatgcattactggcagttttttataggtctttttggatttatttatttatttgagatggagtcttgctctgttgcccaggctggagtgcagcggcactatctcggctcactgcaacctttgcttcctgggttcaagcaattcttttgccttagcctcctgagtagctgggattacaggtgcctgccaccacgcctggctaatttttgtatttgtagtagagatggggttttgccattttggccagactggtttcgatctcctgacctcaggtgattcgcccacctcggcctcccaaagtgctgggattacaggcgtgagccaccgcgcccagccttttttgttatttttaaatttgagaggacaaactagaggactaatttgagattttctaggtttttccctgtaatatagacattagtatttgctgattttagtctgattttccaaaattgcaacttagaataaatttactatttaaaatagaatatttggaggtttcttattacatttatgtctgtttctttaaatatctcaatctagttaggtataaaagtaaatattttcttatttaacgtattacttcttgtaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtaagtgatgtgaaagatgtccactgtcttttgtgcatgatttagtattgcagttataggtaccatcatctcctttaaccagtgaaaacacattggcttctgtgaaattggtcacttaatgtggagcatgtatctaaacatcatcttaaagtaccatttaatggttacacataatgattgtttcctatatgccaggttctgtttgaagtatttacatagatatctcatttccttctcacaactctggaattagtactgttattttctatcctcattttatagaaactgaggctcagaaaggttagtttgcccaaggccacatagctggtaactggtagaataaggagctaactacttattagctatgtcagatgataacttaatgtgacacagcttatggtttcatttgtaataaattcaaaaagtaatagcaaatttcataggtgaatattgaatccattaatctcatagactctttacatttgaaaaattttatagcaccatatagcaaatatagaacagcacatttaacaggtgtacattttagcaaatacttggagtgaacacctatgtaacaactgctaaggttaaaaaaaacgtggctagcgccctagaaactcgagaggttattaagcagttatttcattgcttttctttgtagttttaacaccagttatgtcactaaataacatactgtggtttacctgctttccaccttaaagtaaatgcaatcagtatgtattcttttgagtcttgcttttttcgctcaacctgatgtttcatatattcaactacattgtgtatagttgtagtttcttcactttcacttgtattttgagttccattatgtgaatataccacagtatatccagttgatgactgatattggagttgtttccatttttggctaatactatgcttatatgagtattagatttcccagtgtatatgtgcatacatttctgtagggtctgtacctagaaattgctaggtaatgggtataggtatcttcagcttcactaaataatgtcaaaccaccttccaaaactgtttttaacagtttacagtcccagcaaggaccaaatgaacctgttgttctacatggtggcacttgattttgccaggctattaaatttttaaaaaattagttaatttttccttagcgaggtaatcaagttaaatccagactataaaaattttaccagtctggtagttaggtagtagtatttcatggtggcttcatttacatttccctgagtaggagtgacattgatcgacttttacgtatgtttgttgaccatttggatctcctctttcagttccactctagtttttttcctctgaagttgtcattctttcccttgttaagctgtaagagttctttatatattctgaatattctcagtcctttgttagttgtgtgtattatagatattttcactcattctgtggttatcttttcgttttatggtatcttttgatgaactgaagatcttatttttaatatagtcaattttatcaatcttaaccttaatggttagtgatttttgtggcttatttaagtaatctttgcctaccccatgtttcagaacttttattatttgacctttcacatttagatttattatccacctggaattgttattgtgctcagtatgtggtagattccttcttttcttccccatgtggaatacccatttgtcccaacttaatttattgtgaaagctatccctttccccgctgctttatgtgagtgtgtgtgcgcatgcatatgtgtgtgtctgctatcttgttctttaggaacatcttggctattttctttatctcttagtttttaaatttaataaataggtatattataagttgcacatatttaaagtataaaatttgatacatttttacatatgtacatgcccataaaaccatcaccacagtcaagataatgaacatacctatcacttcaaaagctgctttgtacctctttgtaattccacgctctttccttcatgccatcctcccgccactgatctgctttctattactatagattatgttttctagattctttttagaagtggaattacatagtatatattcttttttgtctggcttctcttattcaccataataatatatttttttgttttgagacggagtcttgctctgttgcccagactggagtgcagtggcacgatcttggctcaccgcctcctgggttcaagcagttctcctgcatcagccttcaccataataattttgagataatctgtgcttttctgtttatcaacagttcattcctttttattgctaagtagtactccattgtatggatgtaccacaatctgtttctccatccacctttgatggacatttgagtttttttttcactttttagctgttacagataaaacttcaagtttgtatacaagtgtacaagtctttgtatgaacatatgctttcatttcttttgggtaaatatctaggaatagtatggctgagtcacgtagtaagtgaatgttctaaatttacaagtacctgccagtttttaaagtgcctgtaccatcttacatctccaccagcaatgtgtgagggttccagttcctctgcatccttactaacacttggtattatctttttgattacgaacatcttagtgggtatgaagttgtatctcattgtggtttgaatttgcgtttctctaatgactaatgatgttgagcattttcacgggcttattttttgccattcatatatctttgatgacttatttgttcaaatctttttccacatatttttattgggttgttggttttctttcactgctgaatcgtgagagttctttaaatattctggatagaagtcttagatatgtgatttgcaaatatattacttctctgtagcttttcattatctgaactgtacctttcaaagagcagaagttcttaatcttgaagtgcagctcttttgtagctccagcttttggtgtcatgtctgagaatatttgcctaatccagggtcaccaagattttctctcgctttttctagattgtatataggttcggattttatatttagttctgtgatccattttgatttactttttgtatatagtataaggtaggaatccaagttttttttgcgtatgggtatctagttgtccccacatttgtaaaaaaaagactgtctttttctccactgaattgtctttacacctatgttgaaaatcagttgactatatgtttttgagctctttgtactgccaaattgatctaggtgccattatcatgctgttttgattactgtaacttaggtaatgcaagtcttgaaattttgtttttcatcaaagctattttgagtattctaggtatttagcatttccatctgaattttatcttgtttttatacactcctccatatgaattttagaattaggttgctgccagtttctgccagacacccgatgagattttgactgggattgcattgatccataaacattggtgtatctctccaatttgtttaggttttctttaatttctctcagcaatgctttgtagatcttacacatcttatatcagatttattcctaagtatttcatatttttgataccattataaatggtattactttcaaaatttcaagttgccattgttcattgcttgtatagtatatagaaatgcaatagttttctttgtatattgatcttgtatattgtagtcttgctaaaagccacttactagttgcagagttcaggggtccccaagaccactgtcatgtttgatagttctctaggagaattcacagaactcagagctgttccactcagggttatttttttattttttatttttttaacagaaaatgatacagattaactcagccaagggaagaggcacatggaatagggtattgtggagtctttatatttatatttatttattttttttgagacatagtctcgctctctcacccaggctagagtgcagtggtgtgatcttggcttattgcaacctctgcctcccaggttcaagcaattctctcgcctcagcctcccaagtagctaggactacaggcgtgaaccatcacaccgggctaatttttgtatttttagtagagtcagggtttcaccatattgtccaggctggtctcaaactcctgacctcaaatgatctgcctgcctcagccttccaaagtgctgggattataggcgtgagccaccacacccagctgagtctttacatgtaaagtaggtttcttgtaggttccatataggtggttgttaattttttagaatccaatttgacagtctcttcctttaaattagggtggttagactatttacatttaagtttatttttaaaattcttttaattgactagtaaaaattgtaggctgggtgcagtggctcacacctttaataccagcactttgggaggccgaggcaggtggatcatttgagctcaggagtttgagaccagcctgggcagcatggcgaaaccccatctctacaaaaaatagaaaaattagccgggcgtggtggtatgcgcctgtagtcccagctacttgggaggctgaggtgggaggatggcttgaacctgggagggggaggttgtagtgagccaagatcatgccactgtactccatccagcatgggtgacagaatgagacccagtctcaaaaaggaaacaaaacagcaacaccaaaattgtatttatttgtggcgtacatgatgttttgatatatgtatacattctggaatggctaaatcaagctatttaacatgtattacctcacatacttaccatgtttttgtggtgagaacacttaaaacctactcttatagcaattttcaaatatataatatgttgttattaactgtagtcaccatgatatacagtagatatcctaaacttcttcctcctaactggaatttttgtgtccttgaccaacatttccccaaccgccccaccccacaacctttggtcaccaccattctctgtttctatgaatttgactttttttagattccacatataagtgagaccatttggtatttgtctttctgtgcctgacttattttacatagcataatgtcctacaggttaatccatgttgtcacaaatatcaagatttcctttttaagggttgaacagtattccattatgtaatataccacattttcattatccatctgttgatggacacttaagttgtctctatcttggatattgtgaatagttgcagtgaacacgggaatgcagatacctctttaatgtactgacttcatatcctttggctgtatacccagtagtgtgattgctgaatcatatgttattagttctactatttttaatttattgaggagtctccatacagttttccataatggctctactaatttacattcctaccaacagtgtacaaagatttccttttctctacatcctcaccaacacttgttatctcttgtctttttgatgatagccatcctaacaggtgtgaggtgatagctcattgtggtttgcattttcctcatgattagtgatgttgagcatttttttcatataccttatttattggccatttgtatgtttgtatgtcttcttttgagaaatgtctattcaggtcctttgcccatttttaaatcaggttgtatttttacaattgagttgtttaatcccttgtatatcttttatattaatctcttatcagatatatgctttgcaaatattttctcccattctttaggttgtctcttcactctgttgattcctttgctgtacagaagctttttagtttgatgtaatcccatttgtctatttttgccttttgttgcctctgcttttcgggtcatatccaaaaaatatttgtgcagaccagtgtcatggagctttctccctgttttcttctaacagttttacagtttcaggtcttatatttaagtatttaatctgtttccagttgatttttgcaatggtttgagatgagggtctcttttgcatgtggataaacagtttgcttaggaccattttttgaagagactatcctttccctgttgtgtgttcttggcatctttgtcaaaaatcagttgactgtaaatacgtggatttatttctgggctctctattctgatccgttggtctatgtgtttgtttttaatgccaggaccatgttgttttggttactatagctttgtagtatattttgagatcaggtagtatgatgatgcctccaactttgttctttttgctgaagattgctttggctattaggggtcttttgtacttccatgtgaattttaggattttttttcctctttctgtgaaaaatgtcattggaattttgatgtggattgcattgaatctgtagattgctttgggaggtatggagattttagcaattttaattcttcccattcatgaacatggaatatctttctgtttatttgtgttgtcttcaatttctttcatcagccttctgtagttttcagtgtatggaccttttgccttcttggctagatttattcataagtgtatattttttgtaagtgggacgtttgtttttgttattactgggttcaaaattaccatcttggtatttaatcgtacatatataacatatatactgaggtgaaattcacataacataaaactaaccattttaaagtgaatagtacaacttagtacattcacaatattgtacaaccactatctctatatggttttaaaatccttttatcacctccaaataaaactgagtacccactgagcagttactcctaattcttccttcctacaactcctggcaaccacagtctgctttctgtccttatggattgacctattctgaatatttcatatatattgaatcatgcaatggctgaactttcgtgtttggcttctttcacttagcataatgcttttgaggttcatgcatgttatagtgtatatatattgctacttcattcctttttatagctcaataggattccactgtatgtatatgccacagtttgttcatccagacatctgttggtggacatctggggtatttccaccttttaactgttgtgaataatgctgctatgaacattgggtataagtattttttcaatacctatttttaggtcttctatttttttgtatatacccaggagtggaattgttggatcatatgataattctatgtttacttttttgaggacccacctaacttttgagcatcttttcatgtacttcctggccatttgtatatcttctccagataaatgtcaactcaagtcctttgcccattttttaattgggtttatctttttgttattgagttgtaagagttctttatatgttctggattctagacccttaccagacacgatttgcaaatattttgtcctgttctctaacttgtctttttcactgttttgataatgttctttgatacaagaaagtttttaattttgatgaagtccaatttatttttaattttgatgaggtccaatttattttttttgttgcttagatcaaatattttcaattccattttcataattctatttttatggatattttcataattatgtcctttgttggcttattagctataactgtttgttgtgtaattttagtggttgctttagggtttataggagacatcttctactcgtagtctgccttcaagaaatctaacgcttcatatatgatataacagtatgcttccattttccccttccccctttgttttcattgctataaattttacttttaaaattatgtaaattcataatacattcttattatttttgcattaaatgttgaatttttatagtttttaataacaagaaggaagcctttcacattttactccatagtttctatttcttgtgctcttcatgcctttgtgtggatcctgatttctatatgatatcattttcccctgcctgaaagacttcctttaacatttcttatattgctggtctgctggggatattttttttttcaggttttgtatctgtgaaaaaggtctttatttcatttctgtttttgcaagatcacttagtgtagaattctagattgacagggttgttgcttttttttcagtacattaaaaatgttatttcattgtcttttggctttgtattattttctgtgagaaatgtgttcacttcagactttattcctctgtacctaatgcctcttttttccccccttcaggctccttttaagatttcctctaggtcgggcatggtggctcacgcctgtaatcccagcactttgggaggctgaggcgggtggaacatgaggtcaggagatcgagaccatcctgactaacatggtgaaaccccgtctctactaaaaaatacaaaaaattagccagtcgtggtggcgggcgcctgtagtcccagctactcgggaggctgaggcaggaggatggcgtgaacccgggaggcagagcttgcagtgagccaagattgtgccactgcactctaccctgggcgacagagcgagactccgtctcaaaaaaaaaaaaaaaaaagaaaaaaaagaaaaaaaagatttcctctttaccatttgttttaagcagtttgtttatgttgtaccttgctatagttttctttttctatctttttttttttttttttttttttttttttgagatggactctttctctgtcacccagactggaatgcagtggcatgatctcagctcactgcaacctccaccttccaggttcaggtgattctcgtgcctcagcctgtggagtagctgggattacaggtgtgcaccaccgcacctggctaatttttgtatttttagtagagatggggtttcaccatgttggccaggctggtctcgaactcctgacctcaggtgatcctcctgcctcagcctcccaaagtgctgcgattacaggtgtgagccaccatgcctggccttctttgtttcttttgcttagatttcattgagctttttggatctgtgggtttatagttttcacgaagcttggaatattttctgttgtccttcaaatatttttttctgtcctccttcagtgattccaattacacatttattagggtgtgtgaagtttttccacagttcattaatactgtttactttttagaaactttattttgagataattgtacattcacatgcagttagaaataatccatagaggtcttatacccattccccagttccccctatggtagcatcttgtctaactatagttcagtatcataaccattttcatttttttgtctcttttctgtttcatttttgatagtttttattgctatttcatgaagtttattaatcttctacagtgtctaaactgctatatttttcgtctcggacattgtagtttttatttctataagtttgatttgcatctttttttttgagactttcttgttctgttgcttaggctggagtgcagtggcacaatcacagctcactgcaacctctacctcctgggctcaagagatcctcccacctcagcctcttgaatagtggaactgcaggtgcatgctaccgtgcctggctaatttaaaaaagttatttttagagagatggggactcactatgttgcccaggctggccttaaacacctgggctcaagcaatcctcttgccttggcctcctaaagtactgggattacaggcatgagccactgtacccagccaagatttgcatgtttttaaaagagcttccttgcctctacttattatgtgcaatcttttctctagcttcttgaacatatggaatataattgtaataacttttaatgcttttgtctactaattttttcatcagtatcatttctgggtttcttttagtttatttttttttgatcgtggtatttttctgccttgcaagcctggtagtttttaattagatggcagatattatgaattttacttcattgggtgctagatattttttattcttataaatgtgcttgattcttgttcttggatgcagttacttagaaatcacttgatctttttgggtcttgctttgttattaggctttatttaaaatgtgtgttttgttttaaaaagagaaaaagccaggtgttgtaaacagtgcaacaatttttgtaacagcaaaaatctgtaaccattctaaatatgtcagttactctgattatactttagtaagtctgaacagtggaatgctcttaaaatggacccttatcatttatttactggtcctaccacccttccaatttcagagtcgcttcagaaatatactgcctgacatctaacttttgtttaaaaaagattaaaagtcttatgaggttctccatgcattgttgtatttgtaattctttctcttactgagctgaaatgtaataaggggagaacagtagacaatgagggtagtgaggtaatgggagacaagatgttaagtgtaaggctttaactttctctcttagtgaggagggaagctactggaaggttatgagcagaagtgtaccttgatcttacattttagagcaggggtcagcaaagtttttctgtaaagagcccatatggtaaatattgtaggctttatggatcacacaatctctgttgcaacttgatttacaaagagacatctggcaggatttggctcccaggctgcggtttgtcgacccctgttttaggactgtatgagctgctatattgagaatagattctagggggtgaaagtggaggtaagaagtccagatgaggagctgtaacagtaacctacatcagagatcatggtatagacccagcagatagaaagtgaatacacagagcaaagaggttctaggactgagcctcagaacaacctaacattcagaagtcagaaagaggaggactcagcaaaattgtctgataaggaatggccagtgatatatgaggaaaaccaagagagaatggtattccagagcaaaaagatgtcaagaaggagagagtacaatagcagaacaacaaataacctgatttaaaaaatggggaaaagacgtgaacagacatttccccaaagaaggcatagaaatggccaccagaggtatatgaaaagatgcttagcatcatcaattatcagggaaatgcaaattaaaagcacaatgagatatcaactggcacttgttagaatggctgttatcaaaaagacaagagataattgttgatgagggtgtggagaaaaaggaaccctagtacactgttggcgggaatgtagattgttacaaccattatggaaaacagtatggaggttcctaaagaaattaaaattagaactaccatgcgacccagcaattcctcttctgagtatataccccaaggaaatgaaatcaccacctcataaagatatctgccctctcatgttcagtgcagcattaatttatagtagccaagatatggaaacatcctaagtgtccatcaatggatgaatggatagagaaaatgtgtctacaatgggatactatttagccttaaaaaaggagattgtgctgtttgccatagcatagattttggaggacattatgctaagtgaagtaagccagacatagaaagacaaaatactgcatgatctcatatgtgtggggaaaaagtcatatatacagttgtataatataataaatataaagaaataaaactggttaccagggataggatgggaggaaatgggaagatgtgggtcaaaggatacaaagtagcaaatatgtaagaggagcaagtcgagagatccaatgtacagcatgaggactgcagctaatgcaattgtattgccttagggatttctgtgaattaagtggattttagctgctcttatcacaaaaaagtaactatgtgagatgatagatatattaatctgattcattatagtaaccactttacttgtctatatgtatcccataacatcatgttgtaaacctcaaatatacacaataaaataccttttttaaaaaaaggagagagtaatcaactgtgtcaaaagctgctgtaggtcagatgagattaaagctgagaagtgaacactagcatttggtaaggtcaagatcagtggtaaccttgataggaatggtttcattgaagtcatgggacaaaagcctgaatggtgtaggtgtgagagaatatggacacaggacaaaagagacggcctcaaagtagttttgctgtaaaggagagcacagaaaagggaagggggctggagaattggagtctagggaggattttttcaacaatggttaatgattacagctgataggtgttcagcaatgaaacaacaaaatctctgccttcatgaagcttacattttagtatcgggtgggggcaggaagatagacagtaataaagaaacacataattatattaaactggctacaagatgttgccactcagatatcatatggacattttgcattcaacatattcaaaatgacattatctcctcccctcccttcccccaccttttcctctattcctcttccttgtttttatattgtaaaaaatgccacattcaggacagaatcttgtgccttatcccttgcaaccatcctgtcctcaaactcaggagtgtttttttttttcttcacaaacagttcctcaggtctgctccctccttgccatctctacctcggcccattggcattcacttctcttctggatcgctacctcaccgtcttaactagagtctctgccttcgtcctccccctttaatctcttctccacaatgtagccagagtcatcttttaaaaatataacctgagagttttaagggacttactcaagaccacaagattcatagagccaagatttgatttccttatgtcatgctcctcttggggctggctttatgtagggggtaggaaggagctaggtcatcttaagctaagtaagatatgaacattgccagaaatgcatgtttgtatgtaactgacagctcatcaatttgtctgatgttggtttgtttttgtaggtgcacaggtttcatattccagaaggttggaaagttggctgcaacagctgtgggaggtggattttttctccttcaggtctgtatgtgaaatgttctcagatgtttggaaattccacctgcccattaaggaatgtggtgtggggagttgtaatacagtcctggctatgtcacactagactagccttagcacttgttttcatgtactattttaaatgctagtgaccgtttgagtcaaattttattcattatactagtaaatgttatttgccagtcccattttatttcctcatgtggcgacagaagtgcaaattccttatcatagctcccttaaaagagtttttaagaccagctgaattattaagcggatgtgatttcaaaaatacaagtgtgctgtgatgatttagtgtcatatgctaatattatagctagctttcacagaggggatgttgagcatgtgatgagaaatgggagctaagtgacagtacagtcagatgtcgtctgctgtctccttgacccatagtttcagaaccagtggttgccagttctctgagactgcttaggagagactaacaagcaagacttgaaaaagggagcagtttctccaaaaacaaaagaaaactgacatttgattgtattaggcatacatttcttagctctgtggcattggtattcaaatttggctccacattggaatcacctaggagtttttaaaagagccaacgtgtgccactcctgacccacagtctgatttcattggaaaacttaaaactcctgaggtgattctgctgtgctgtgggagccataacttgctgaatcatgccagagtctctgaattcacagccgtttgtctcttcccacagttggcaaccctcacttttgcaaggtaagttctgcattagcaccatgattggagtgagttttgcagataggtcaggtgaaaatcaaatgtatcgaagagggaagctggtaactggctgtagctgggttgagtgtggtattgctgcatgacaaattcccccaaacctaatggcttcaaataatgatcactttattctctctcatggttacaggagtttggggagggttaaggtaggtgcttgtggatcagagtctcatgtggttacaggccagatgatcagagggttagggtaggtctggacttgtggggcctctttgtgtctctgtctctgtttgtcttccctcctcctctccttatttcccccctgtccatagtctcagtgctcttccatgtggtccctgtgccagtataggcttcctcacactaccatgacctcaggactcccaagcacagttctgcagaaacatggtgcaagttgcatctcctttgttgcccaagcctcacttttgttggctgcttccctgtgggcttgttacgtgctggctctgttgctagacaggtcagactccctgcaaggtggggcccctcctcacacctctctctccttccccttgacccttcaggtggaagtgcagtaacatctctatccctgtggtttcccttatatgctgccccaaacttcataaacattttaatattgctttgaaatgtcttaatttgagtgtgtcctctgtttcgttttggggccctgacagaaataattggtattgaaaatgtctccagaaaggcacctcaaaatgagattttggggttggataattccaatattcaaggggtacagggacactgctttgctgcagaggtgagacatggagaatctgtggcaggcactcatgttatctgtcaccaggggagtgagagcaggaggcaagcataatgttgggagatcagttatatcacaagttatagtttgacatagggatccagtttccttttttccatactgataattgagcagaatttagtgaataattcttccctttcccaacatttgcagcattgtctctttcatatatcagaacccatgtatgtgtggctgtgactctggtttctgtgttctgttccactggtcaactttcgatctttatgacagtactaaagcttaatatttggtaatgcaaattcctccaccttattcttcaggagtgttgcagctacttttgtgtttctgctcattcatctaaattttagatcagacttgtcagttattttcaaaaatcctgttgaaatttttatcggaattgcattggaaccatgtagatatctcttatgatattgagtattctatctgtgaacacgggctttctctccaattatttaggtcttctttaatgcctttgaatagactttttattatttttccgtatagatcttgtacatctgtgattcagttttattcctggataccttataactttagttgctcttgtggatgatacgatttttaaaactacacattctgattcatgctagtgtgttgaaatacagttgatattttatgttgctctttcagccagccaccttgttaaaaaagtcttgtctgggattcttttgggttttgtctataaaatctttttatgccatctgtgaacagtgaaatttttccttcacgtctttatgaatgtagttgctttttcttaccaagctgtagatcatttccagcactttttgcagctttcagagcccagcagcaacgcttgccagttttcagtttattcggctccctctacttgttgtgctgcaatggaagtaggatgttgagctttgtcagtagagggcgctggagggaccttgcagcgggagaggctgcttttcccagttctggtgttgctttgcccctgcagtgcagtcccccagtaatgccaaggagagcaggaagtcacctcgcaatcctggcctgggccacccaggggacttcaccaccaccattactacttttgcccccttgtgaaaaatcagtttgttgtagttgtccacgtccgtttctgtactttttattctgttctgttggtctgtgtgtctatctcttcttcagtatgacacactgtcttgactactgtagcattatagtaaatcttaaatcaggtagtgtgatttccccaactctgttctttttcagattcattttggtgattccagttcctttgcctttccatataaatcttagaaccggcttatttatgtatctataagaaatcctactgggatttgtgatttgggattgcagtaaatctatggataatttggagagaactgggcatcatttctgtgttgagtattccattccatgtacatgatgtgtctctccatttatttaggttgtctttgagttctttcttcagcattttgtagttctcagtatacagatcctgtatgttttatttgatttgtacctaatatttaattattttttgcacccattgttgtaaatcatttaaacatttttcatttccagttcaaattgctagcatatagaaattcagttggttttgtgtgaatttgtgtcctgtgaccctgctaaactcacttttttagtctaggagtttttgttttttgttgaagtctatgaaattttctatgtagacaaagatgtctatgattggagacagtttgacctcttccttgtgaatcaggatgcctcctaattctttttcttgccttgttgtgctgactctgaattcacttctggtacgatatttaataggagtggagacggcggacagctttgccttgttccctgcattcgttctttcaccattctgtacagtgttagctgcagggttttttatgtagatgttctttatcaagttgaggaagttcccctctattgctctttctctgagagttttatcatgaatttgcgttgaattttgtcagatgtttcttgagtcctgccttgaggttaggccaggcgatactgcaggaaaagcaggaaacacgccaccagtttggtggtgctttgaattctggtcttctccaatctgcacgtcgctgtttttatgtaagagccttcaaatagctagtccatgtattctctcagtttaatagcaggattttgtgggataaacagggtggagtaaatgaaccagagccttcttttagatacaaatgttgatactcaactatgtggttgctgtaagtaatttgttctttttagtactaagtaatattctattgtgtaaatatgatacaatttgtttatccattcatgtgttgatagacttttgtgtatttccagttatagactcataaataaaggtactatggcttgattacttgtgaagttgaactttttcctttttgtggacactttcctctgaattgcccttacccatttttaaagtgaactttcttactgatctctataagaagttcacttttttgagtatcaatgttttgtttatgatacacatcacaagtattttctctagtctgtttgggtgactggtggtgccattagctaaaatagggcctagaggaagagcaacaatgcaggaggagactctagcaaggtgaagacttttagtttcagatattttgagattgccaaaaatttggtagagagaagtgatattgatagggcattgattgattggctacagtcattctcttcattcctaggatgatattaatccatcatcaaaatctacatgcttgaatcagatttacactgagttttagtgtttgtgcctgctgtttttatcaagggaaataggtatatgctgtaggtgtctttggatgtggttctcttaatatccgtttatatgaacttgctcatgagaaatctctgtggggccagatgctagatttcttcctgttaagcaacagtaataactgcctgaatgctttgctctgttcacattgtcaggaaactgacactcatgggcacattgtcagagtcattctctggaaacatttgtattggctgtaaggtccatctcttcaccctacatcttgaccccccaccttgattttcatcttatgtaactctttgtaaaagggttgtaagagtataaataatttaaaagaattgccagtagttatttctagtgccaggcatatggcttcgcatataggggggatgctgagtagatgtcatcatgatacaaagaatcaaatggcagatgtctccaaaaatggaaagtcagagggtttcgagagtctacttcaggatttatcctgactaaaagaaataacaaatctgtttctcatttcttgttgtcattattgttgatactgtagcttgcaaaccatactgggtacatcaaagttgactggcaacgagtggagaaggacatgaagaaagccaaagagcagctgaagatccgtaagagcaatcagatacctactgaggtcaggagcaaagctgaggaggtgagacttgcattgttcacgtgtagtgtgtgaacagtgcagacaaaaacagggcttaaccctattgtaccatatctcagtgatggacagggcttaagcattacaaagaacttagagtaatgagacaaaactaacttggattatcatcacttcagaacatttttaaaagctggataattgtttggtgacctttgtctgtgcacatttgtggagtgattatccctttaaccagttcttgtaggaatgtggggcagcatagtaggtgggaaggatatatggccagtataattattttgagtcccattttgtcgctatacacgcatatctctgaaacattcatactctgcttgttctgcatataactagtggaaatgtcacaagtattcaactccactgtatatcatcaaaatagccatagatgatatgttaaataagtggatgtggctgtgttgcaataaaactttatttaaaaacaggttcagattggatttggcccatgggctgtagtttgctaacccctgatcttgttcattaaagccaagttagattatgacctggcactgcagggacaggagaagtccttcctttttaaaaggatattttttgctgctgctttattacctttagaaatatgtcagatgttgcaaataaataagtacactgaactggggagaaataaacaaggatcagggtgtcaagaagatagctggtactttctgtagcctggagtgatgagagattctcccattagctcactctagcctcacagggaaaacagacagattgagtgcaggggaggagaaataccctgtgtgcgcctcaggcttctcatgttgtgagtggctcttcgtgctggtgattggcaagtggctggtcaaagctggtgcctttacccagagtgggaaggtggcagagatgggtatctacaggagcccagagcccagatagtttctctttcctttcttccttctgtctctcctcaaagttaggaaagttacattttttatttcatgaaaactttattattcaaatgtttataaaaataatgcatggctgggcacagtgactcaccacagtgagtaaaaaaaaattttgtaagagaggtctcactctgttgcccaggctggagtgcagtggcacagtcatggctcactgttgcctcaaccaagcgatcctctgacctcagccttctgagtagctgggtctataggtgtgtaccaccacacccggtgaagttttaaattttttggagagacagggtctccctgtgttgtcctggctggtctcaaacttctgggctcaagcagtattcccacctcggcctcccaaagtgctggcattacaggtgtgagccatggcaccttgctgaaaactttaaaaataatactggaagtgtatataataaaaagcataaagttaatatttgattagaaccaactgttgactcacagagggagtttgttataaagtaaccagataatttggaattgagttcactgtcacaggccctggggatgtagtggctggttttcctactcatagagccggtggtctgatttgagaaacaggatgaagatttagttcagtatttaccaacaagatgacttcagtgagaacagtttggtggggtggtggagttgaaagccaaattagcaagttgaagaaagagtagtaaaaataataaacgaaaccaattttctcaggaagttgtatgattttttttcttcaccccaatggcagatgacaaaagtgcttcatttaaggaaatgtagaggtccaggagagatggaggaggagtggaaatgaggcaggaagacataggcatcgttggagtaagggcttactggagggttagaagacagtggtcctaggaggatggggttggtagtgtgaaaaatgttaggggaatgtcagggtgtgagtagcttaggtggtttggggatggaagtcaccgtacttgagttcaagaaatgatcaggccaggatgttggatgtcttgttcatatgaacactttctaaggtggtgatcacacttaggagaaagaggaagtctgagccacttatcaaaattgtctctgaaattggaagggtggggagtggtcaggagattggtagagcacagactaaggagccataaagagtgtctgaatgtatgcactgagtctcagatgaccgggagctattccaggagggtagaggggaggtgggaagctttgggaacttaaggaaataagaacgtcacctgttaatcatcttagatgtggtgaagtgtgagaatgagaatttatagcatctacctgggagcaggtttcaggggggaatgcatggatggagagatttaggggagagacttcaggaaatgagaagcctctattggagggtagatgccaaagaggatggaaggagcaaaattggaaacagaattgcctctgtaaccagtttatttagtgcagctttactctttcgccataactgtccccatgaactctccttctttgtccttgattcaaagagccattgtctctacctcctgatgtgcatcctccttcccatcaggctccctctagtcttattctccccacaccagccagtagtcattttcatatgtaagtctatttaattattattaaatagactattagtgtaagtccattgccctttgggtaaagtgcaaattacgtaaccgatgaggggattgacattgttaagactggcataggtataatagagatgattcttaatattattaacatccttagcaaaacaacccattgtactatcttctgttttcaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccagggattcagaattaagaaagatagtgataggacatgagaaataaatttccatcaagtgtaatctaccgtctcatgatgaccacaaccctgagaattattctttaaaagcttacacacacacacacacacgggcacacacgcacacacagaatcttaccacattttgctgtagtggcatgttaccatgtctacagtccctactagaatatcagtcagctttcagagggcaagacttctgtcttcaccattatactcacagggcctagcacttaataggtgctgagtatttgaataatgactttatagaaagaaaactcactattaaaggttagttttactcagaattgttaatcttggagatgatctcttgtgaaatatgagtgtgtttctaaggccatacatttaaaaatgtttgcattttaacccgtcttgagaatgatgtattgaatttgaaaatcaaaactaccagtggatgtgtggaactttacagaaaccacctatttgcgtttttctccttacatttaaggaaacataagccattttgcttgcaatatgtatgaatcatctcaaaaccataatggtatgagcctctttgctgcatattttgctataagaacttattttttttcactttttattatggacgctttcaggaatatataaaagtagagaatatagtacaataatccccctgtgtatctatcactcactcacaacaatcatcaaattatagctctgctggtttttaccagttattgtgaaacaaatatcaaaatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgtattctgattgtctgaattaagatctgtaggtaggtccctcctgaagttttttcccagctggctgcctctacgactgtgagggtcatggttgaggtcagtattgcaggttggcctcatcctgctagtatgagaacggctgtgagttctgcccacggtgtgaggccactgtgaccacttgggattgtgcagagctggcatggaggttgaacacgcacagctgcacaccttgttttcagtttagctgaaccatcggtgaaggaggctcaggcatttggggttacctgtgaatcaaggccctattgtgccagcagttttgtttcaggtggtgaagtgggagttaaggtttcccccaaaagaacagctgccactcctccatgcaaaaccgagatgattcaaggaccaggcagctccacctttcagtgcactactttcatttgactggagaggcctgcttagctaggcacgtattttctccagtagcagagtccaatgacgctctggacttcctaattagtggtggtggggcggaagtttttccttgggaagagcgttgtcgctgtatatggtccgcagaaacttgacttggaatgtgttcggggtttcatcgcccccttgtggcggcgacgtggtaacaccgcactcaaggcttccaacttgtcaaccaataggatggcatctacgtagtgaaggcttcccttcccttgtcctgcagcgtgctggacagtgtcccggctcagggaccccttctgtccccttcctggctactatgggtcggccctgcgtcctcaccactttgagccaccctttgacccagcgtctctcccgcaatgggacctggtgggatggggacttggagcatgctacaggagaggtagaacttttgagtctcttcttcccaaggttctccccagagtcggagagcagagacggatccaggggcactttctggccgctgcctgctcgggctcaacagatggagtccaatgtttcagtctcccccaagaatgtgtatcctcattgctgacacgggagctgggtgcggggagagatgtggtggtggggacccttgcctgagcagcccattgtcatgagtgttattgccattgtgataatatgttagcatgactctcctcccaaatggccgcttgtttgttgcaatctcccgccactcagcctccagacattcattaacaggacagtggggttcttgactcccctaccactggggtgacagtccttgctactggatctgggcagttactgtctcatggatgctggcagaagacgattcaagttggcggactagattctacaaggaatgatctcttgcataattctagccaacatgctcttggggtgggtgcttctggttttggaaagcaaagttactgtgtagttaacaactattgtggtaagaatagtctctccatcattcttttgtttcacggttgtcagaaagatgggcataactaatggttgggctcttatttggaacctctacttttgtacagtttgggaatctctgcttgaaaagatggtatactgatggatttgaaatttctgagtatcatcaatgtttcatgatgatctcaatttcttctcagagggaagctcacagccagttttggaccccagagaaaaatgtggctgctgccctctactccctctaccaaattatcagcttcatttctttgtcatgaaatctagtatgatttctcagaaatcaggcccagaactaaaatacattttctgcccaattttctaagaggtcacactaacatctgagtaattgggcagaaaacctattttagttctgagcctgatttttctagaagtcatatggtatagcttatatttccgatgcttgcattctttttaaggggtcatgaatcttaatacttttttttttaaaagaaaagtgtcgcactttttcacatttttataaagctttaaagtcagtttactgacttttcaaaagtgtctacctttttaaattttaaaatggtaagaaatgacattcctgagagcagtggctttcatccttgcttgcacttgggaatcacctgtgaaattttaaaaactactaatgcctggctctcatcctagagattctgatttcactggtctggagtgctgttcaggcatcctgaggttttaaagtgtcttagctttttctaatgagcagcagagactgagaaccactgaagtacacagttggaagctggtgctgaaaaaattaagagttttgctgttaactccttaagagggctttaaagccttttatattaagtgccatacaacttcagatgccttctgaatactgaacacaagtgtaatattatagttcattaaatgtcttaggaatcgtgtggagtgaatgcaaggaaaggagtgacaagatatcaccccacaaatgacttacccattacgaagggaaaactacctttctagctaaaaggtctgtcagtcactaaccaagtgattaaacttagcatcactaatagccaacttaacaaagtttttttttttttttggtttctaaaatgggagatcatagttttcaccttcctagagttctttgcttaagactgagattcagtgttactcttggtccctaacaataagaagcactcagtaaatgttaagccttctatgatggctattttatttttttgtatgtcataataatacctaagaataagaagagttaaattaatgtcttcaaatggatttgttgacttaaactgacacaatcctttaaaagaaggaactgatttgaacctttcaaaactgaaagaaagtcgtatactgatacagtttggagccaccgaatgtcatgttgaaccgtattccctaatggaggtggatcctggtgagaggtgattggatcgtgggggccatcccctcttggtacttcactcatgatagtgagttctcatgagatctggcacttcacccctcactctctcttgctcctgctttggccatgtggagtgctcactccccttttgctttctgccatggctgtaagtttcctgaggcgtccccagaagcccatcagataccagtgccatgcttcctgtacagcccatggaactgtgagccaactaaacctcttttatttataaattaccgagtctcaggcactttttatagcaatgcaacaatggactaatacatatactttagcataaaaacatttaaaagagtctgaaactggagtagttaactcagtaaaaataacttggcaataaaacacagaaaaacaatctatttgatcatgtagtgattcctaatgtaaatcctagtacaactgtcaactgataattttaaatgtaatttagatttgtagatggtgtaacattaaagttgtatgatgttttattgtgttattattaacacaagacgtcatttaaatttcatggggatttagctctgtcactctggtttgtggaccaaacgtctctaaggcagcatttctttaagtcgctctggagagcattcacacacagagatgctgtctgcaaaacaggttcacttaggttttttgaaagctctgaagtctgacaggaaattaacctgtgtacttgtatgcaacctagcattccccaaacttacctgaccagagaagccttttttttttcttccggttacagcaattcctagaaacactttgagtaatgctgctttaaagaaaacagttggtctcaaataatcatggtattttaacatcagggacctagcagaaattgttcctgcttttagtcatctttttcttttttagaggacagcctttggtggttcaagcatccatttgaggaaagcaaatggcctgttgcatgctgcctcctcctacttcataaagtgactgacagctgtcaacaggcttcattcagcagctttgtattaatgttgtctggatcctctgtaacaggtttttattatcaggatataaagaatagataaaccaactaagtttgaattatcttgctgcctacctgacttccaatgaaaattttttcttcagttccttcatgataaattaaggatcattaagcattacaagaatcatttctatgcctttcctacctggttagtcgctgcagtggggatgcaaaagcagaaagaaatgctcttactggcatctggaaagacactttttgctctgcatttttggaagtacaaaaggtaatgagttagtttaaaggaaactttgaattagtttagcatgtaatctataaaaggtatcaaaattggctcacgcctgtaatcccagcactttgggaggccgaggcgggcagatcacgaggtcaggagttcaagaccagcctgaccaacatggtgaaaccccgtctactaagaacacaaaaattagccaggcgtggtggtgcatgcctataatcccagctacttgggaggctgaggcagaattgcttgaacccggcaggcagaggttgcggtgggccgagatcgcaccattgcactgtagcctggatgacagagtgagactccatctcaaaaaaaaaaaaaaaaaaaaaaaaaagggcgtcaaaattgtgatgctggaagtgagtcctttcacctaacatacctcatatgacttaaatttgatgaatggcactagtggcttgaacttcaagagaattcattaataccctatatctaatagtcttaaaatacatttagtacaaaacccaaatttttctcttaaacaggtttattttagcagctcagtatattacattctacatatttgtcttttaatgtgtttatatttctgcctgttctgcatagatggcatattcattaacttttgtagctgactttttcatttgctatttgctgctacctggcctgaagagtcaggaggataaaaaaaattcatttggtggaaacatggagcagcacttcagaagaactttactttgatgcagacttccgtgttaggttttcttcctcttctttttcaaatcctgaacagacgacagatcttcccttgggatactgagcacaacacttacgcagttcttggatgacagcctgacactttgattccatgtagctgttggctgaaaaacatacaggcagactctagtcatgatctcataggactaaggtacagggaggtttagatcagtgcttcccaccccttttcactttcagtacctatggaactggaagaaagaagatataccaaagtccactgaattctttctaatttagagacctgtcgacaggttcgttagggaaagtatgatttacaaagtggttgaaagctattttaatatataatttcctttaaggttaatagcatgtatgcacctttttctaggacattggtttttaacatcatttttattactggtcactaatttgatgaattaggaaaatgcacatacaccacacattattttgcatacagtttaagctgattgttggacctcccctactaaggctgtgcatcaggaattggcaaactgcagccttagggtcaaattcagccggtttttacagctgggagctaaaaatggattttaatttttaaagggttgtaaacacacaacacatacacaatatatacaacaaaggcctttggcctccaaagcctaaaatattacttgtttggcctttttcataaaacatttgcagatccctactatacataaacactaagttaaggaggacctgacctaaagactctaggtcagctgcagttaatgagtcccccagtactaaaatggagtacatggtagttagctcaggataggaaagacaattctgattagaaaggcagtatagcaaggtgggtaacagtccagatttggagctagaccaagggcggggttggcggggggtgttcaaattcccaccatacctcttactagctatgtgaccctagtcaaattacataacttgtgtgtctgttttcccctttatgaaatgggggtcatagtagcatctacctcatggatgaaaggcttaatacgtataaagtccttataacggtgcttgtcatcttttagtctttccagttcttaatcctcccacactgccaagggggtgtcaccagctctttttaacttatttttttcccttagctatgggttatttcaaacaaggtaaggttttatttgggagaaggaattaaatgcaaaaaactttttccttttccttaaagttggagggaagaagtttgactaaaatggcattattatacatccagattttaatctaaaagattttataaaatattgctaacatcaaaaaatgaaaagtccaagaatgaaagctaaaagtccaaggagatacacaaacaaaggatttctttggtggtgaatctttgggggaactctgaacatttttccttcatacctttctatattttcatgaccttccatctccatctattactttactagtgaggaaaacttattaaaattttttcaaattcagatagccttatagctttttctatttgctcttctggcaacagtcattcactgattagaaaactaaaatcctctaacatttggtcaaacttagcagctggacaaatggacaaatcacctcaaatatgctttagtcgagattcacttctgcctttaagagttagttgatgactttggcagcctgaattccaattgttatttcaaccgcacctcttccagattgcttttaaaaagtgaattgtcagctgcagtgaagtataaccaaccaatttaaaactagccttttagtaaaaacaaacaacaacaacaaaaaaccctttttttcctagccctagccctaggaagtctgaattgttctaggtaagtgtttaaagatctccaggtgatgctaatcacctggagtgaaaacccctagctttgatcacattactttttattttctgcatctttgatgatacaatgaagagaatcttcaggataattacatatacgttacattcttaaaaaagagttaatacagataaaagaataattggtctcttatagttagttcacagtggaaaaatatttttaaagcattttacaatatactaccttgtaaacatttctgtatctcacaggcttgcttctggcacggatccttctgcggcatatccagaaaactaaaacaagaaaaatgatttttatttttcttttttccataaagactttaaagcccctctacgtggaattttcttctgagacaagcagtatatgcccttacaattgctggaaaataattacactaaaaatactcttcccaaacataggatgaatcaactgtatttttataatatccatttcattaggcttggaagatataaatagctttacatggaaaaaaaaccttgaattcaatcaactctttttgaatactgtaaaccaacgttaggctagaggagccgacggcgcagcctggctctatcattcgcagaagaaacccttgataaatgattaaactccttgagctttttttattactcatatataaaatgggaatcatacctacctcaaagcattgacaggaggattaaatgtgataaagtatataaagtacatacaatagtgcctggaaaggactccaatacatggtagctattattcccaagacttttttttttaaagtaaaaccttacttttaatgtatataaactgttataactactttaactcaggaaattctttacaagtagtaaatgttttcctaggaatcagcaatatttggtgttattacttcctgagaaaggtgccagttaagcagctaaaatggtttttcttgaagttcttatagaaaccagcttatttaaaatatctgtaatcagagaatgaattcaagagcccacaattttgatcagcaacttccagtaatttgaagacacgatttcagatagaaaaaaaggcccacaagcctttgtagctaatttcatcaatgcatatctcttttcagagccctctaaatactcagcagatccaaattaggtcagtactgggatgggaaacactggagcaaaacctaggatatttacaggatgggagaaggaaaggcaggtgaattgctgcagggcaaataagcgacaaatagatgttgatgctgctaggagctgctctcttctctctaaatcagtaccaagtccttggtgatcagggcatctgttctgtagaaggtgctgacttttgtgggattcatcagatcccaggtccagccgatgatgtccattaagggttctatggcaatttccaaaggagtcaatttcaagttacggatcctgactaagtgcttttgttgacttgctttctgcctacgtaacctctctctgcagtttcacttgcagtattcttcatgacccttgctaaacttctgtttcttgagcagtttttcaacccactccctccccccaggcccaagggtgggtgcactgcagtagtggatgaagtgattgccaaatactgaacagaacaaaggagcatatcttcgtagaatcccagcacctggaaaaaaaaatcattaaaatcaccacaactgaatagagccaaaacaaagagggggaggacagaggagaaatagaaatacataccaggttagtcatcaggcaaaagcttaagcaacagctcctgtactcccctgacctgtcagaaaaagaaaagtttatggagtactctgttacgagagtcccagtacaatggaaaataattaagcaacatgtgtaccattaaatgatgctgtatctgccacaagcgagagttgttatccatgtagcgctcctccgggtagagttgccacatgagaggtagctgggaggtaagaaggtgacttggcctagctgcgtcacctaagggaacctgaatttgctggactcgtgcccttaggaaactcgtctcctaatggaaaggaatgatcaaaaataaaaccaaagacttcagaatattgagactggaatagaaaccaagttacttgaaagcaaaatcaaagaaataagcaaaatgtaaacagttacctcttccacgacggccacccacgtgcgctggtattcgtcgcggtagataccctcttggtgaacccagaggtgatcgggtggagcccccacatcctctcctgccattctgggctttgggttccaattctagccctgcttttctccacctaagcctgcagcacccgcgcacaggacacaggtgtgactttttgggtttgaatgaactcaccagtaagcaaggtgatctggtactagcaaccactaaccagaaccaaacctcatatgtctatttgcacaacctaaatagaaccaaggacatctgaagctttctgcaagacaactaaagtgacactcaggcagagcctcaggtagtgctgctgactgcaaagcgctcaagaatttggctaggtgaggagttctgtggaaatgtaggactagcactacaggaagctgggcagtggtctcacacatactgcattcacaagcagtgtctggcaaaatgtagttagcaatagaatatgcaaagagcgtgcctaaagacacacttattttggcaggaaggcagtataacagacacatgcatgtcatattccccaggtaaaagccacttccaagcagtttccattttaaaaggtaagattctgaaggacatatatgcatgtctttcagagttgaaattaaaagtttgttttaagggcaaatgatctatttatcagtttactaagaaagtttacaaatagcggatgggcatttctagaaggggattttcttgttaggaaaagtaagctagcttcatggaatttctgagctgcaagagactttggggatcatgctgatttggagctgagtgagtgcaaatgaaagttatccatctaggtccttgttttattttaataattctgcaggatgttacaggagcccatttttccatagaggactaggtttaaattttgacttcctaagccagaagaccagaagcacatttgagaggtgtaaaggaagcatacctcccaaagcatttgagtggtagggcaaactctataacgatcctctgcccaagccccagatatcatttcaggacctcacaataacttgatgtgcattttgcatgagtcaatcttctagaccttactcagagcattatagcgcagttgtactgtatttctacctttggccagagtatagatacggcactggggagctgcccctcaaaacaaagacctgctattctcattaggtgggaaaagaaatgcagcgtgggagggtggttgttagagtcctcaaagtgagactgtcgagagcaaccagatgcttcacccattataccctgagtgcatctgactctgagcctggtgtaagctcctgtcttagttttcatacatatgtgctctctcatttcaaactcgtctaaactttctctttaaccaaatcctgatttctctcaatggcaacaccaccattcctgatcctgcagactcaaaacttatgaattatcttggatttcttcctcttattcagttgctacatcctatatgtcaccaattccagcaggcactacaactaccactgcagttgagaccaactttccccaaataccaggctcatttctagctccatacccttgctcttgttttccacttgcctaaaatgcctccctgggcctctctgcctatcttagtgctattatagcagagtccaggtgcctgcctcctctatgaaaactttagaaaattcttgcctcttttgactactgtagcatttatatttaaacaaagtcaccttacacatttgctttgcttatttcacaagtcctgtcttccctaaagcacagtattgtattctgctcaatagcaggaatgatacagttctgggcaccccaagtctcaggtactggtcaagcaatgtttcagtgaacaggtgtatatgtatggtgggtagggaagggaaacaaaggaacgccacagtggttgtcatgattggctatgtatacgtgggtagagattgattctctaggcataagcctctggctatatataatttttttccaaagccccccttttttcccatttgcagatacagttgttttgcctctcttccttcccagagctttggaaaagagaaatacaaataaaaacctggtaaatactaatgtcaaaataaaatatattaaattcggatttcaagcacagaagacttaagtgtggccaataactgttttaaaaaagtggaaaccatgtgttaagggtttcaggaccatctcaatttcatagataggtcctagcaacaaccaacatgttgacatttaaatttgttttgaatggaaaacaaaattgcattggttatattgacattaaaaggaaataatgccagtggaatagagggcaaagagtttggagatgatggtctgagttactgagtcactacaaagaggcctatgagtcactacaaaatattctcagaagaaaggcagtgtgatgtgctgctgtgacccaaaggtcaacatgctgggcatcagcgggatgagcttgggaaccacctctcagcacagtatcctggaattgtgtgtgctagcattcagagggcatgcaggcccagagaaagacaactgcagtgatcaagggacagagaagtcaccatatgagcatgaacaaagtcctcagcagagaaatgcaaaggctgagggagagggattcagatcaaagcctatacaatcacaggttttatgagtggaaaaatgtgattcttagaaaacttgctcccaacattttccttggtcaaataagtttgggaatcttggagagtcataaagcacattagtgtagtaactgttctggcaagttatgcagtaaagaaactttatgttaacatttcccaaatttatttgactagagaacattttatttgcacatgatacttgtttacaaaattcaggacttctcgaactaagacgaatcttttaaaacctcaacatagacttaggtacaaggtgcaatacaatacatggaatataaacttgtgcaactcaactcaaggaatactgccagctacaaatacaaatgaattccaaaaatgtttagataactgcataactttatcatccactagaagagattgtccccatgagggtcaccttgatttcggggccagagagcacactggccaagacagacaatttcttagtaaggcattttgtaaattaggttttaaatggatgacatataagatagaagggcttccttaggtagtaatctaagtaaaactatcatttttcctttacagaataaattcttttgtgtcttttttaaaaaagtatagtttgctttaattgccaggttgatgaacagtttttaaacattgatcagttgaatacacttattttattagaagtcaattaataaactcgtccaattacaatgagtgaaattaccaagaacacaggcccaggcctgtgtatgagtcctgagtctgtcacttactagctttgtgaccttggacaagttaacgtctctccacctcagtttcctgaggtgtaaaatgagaattaaagaacatattaatcatgatagtctttatttagcatttcctatatgtttacatatattgactcatttaattttcacaatcttcatagggcgctatgaggtgggcagaattattatcatccccacttaaaggtgaggaaaagaaaggcacagagaagttaggtaacttgctcaaggtcacacagtggggaagttgttgagcttgactccaaatggggcagtttacatgtaccaggcatataaatgcttagtatctagcatataataagcttgccataaatgttaataattttgttctactccagttaaatgcctggagctgtaaaaggcagccatgagcattagaaaagttagtgaacctcattctggaatatgagattgactaccgccgataacaaacaaaaggtatttttcttcttgaaagtgcctaaaggcactatatcccatcaccaaatgttaatgtcataataataagaacagccgttcctgctccatgaggacggggcatactagccacaaacagtaactgaaaataacatatgatataaaattgaaacaagagaaaatttagacaggtccaatgtaactgcacacgaaaattttccaaccttcatcatgatcaaattaattatagaaagatgtgccatgtgatccttacagatcgttaggtaaaaacggaggctgctggcgtgcacattacagatcgttgcactggatggggaccctatgtgtggggagacttgggttggaactgacttgggagaaaagagcaaagcatcaacacttcaagtagcaccttgggaatgttccctttccagtactgccatacctgcctggcttcaaaactacacaaagtagaaaaccaaatcaaagacacgaacacggacgggctgtggaggcggcacggcatatattgtgctttgatttagaatcgctttcaaaatccacgtgtgattcctagacttgtgagttggaagatctgtacttttatccttggcacgtttgacatacctcgaaataaaaattacttttacatatatttttactgtctgatatcatcgagacaaggagacccgaggaaacttgcattctggatacctaatgtgatacatccgaacttgaataaaaactgaagttctccatttccccttccctgtatccaacaaatagctacctaaaagcctttgtagaaagtagcagcagccaagcttaagagtgatactttttcagatacagtataacactgtttctgcaaaaggttactcacatgaatataatgtttcttgggctaattaatccgccttgagaacagctaggctaaaacttccaggtctcccaccctgggccactcaagccaggatcgcgacgtgagcccggggtgagccgaggggcatcccgggccgaggtcactcgaaccgaagttatgaggcgcgggccggcaaccggaagtggtccagggagagttgtacgagattcgggggctgtgacttggaaataaaacaaaataaaataaaaccttaactgttttgggactgactttcaaaagagcgtccccctggctcaagaggccggcgttcgcggagatgtcgtcttaaagggctgtcccccaagcgtgtaggccgcgcacgggtctccttagcgggcgggcaaaatgggcgccggtactcgggaggcgcctgcccaggcgcccgggcgccgctcacagagtacgtccgcctgcggccccagagcgccgcctccctgccgcccccgccgcccggcctgacgcccggaccgcggccggccaccgccctccgccccgacggccacgcctgccccaaaccgcgcgggcgtttcccaggtgctgctgggcgggccccgcccccgtgccccaaggcccgcccccgcgcgccagccgcgcgcccgctgccccctcctcgcccccacagccccgcccccacagccccgcccgctccctaagccccgccccctaggaacccgcgcgccgaaggccaggcctgggcggagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggaggtgagtaggtctgttagcctggatggaaccctgctgagcagtcccagtgtgtccccggggtgggtgccggcagctcccagggctgcggaggccacaggcatcctcgatttaggtccttggacaccctttacatagctctgtcgcggggagccccgtttcttctggccgcctgacacttgtttagtctcctgcgagcccccggcggtctgtacaggccccgggagccttgccctttctcctgtagcctggggcttctctttagatctgcgcttttcgcccggttgaccaaaactgcaaggcaggtcagaaagacactggagtataatgaggatgtccgggtattacgacgcagcagctgaccacagttagagccccttgcctcgcctcgagtcttctgtctagggagcagagatatcaaccaaagcatttgaagggtatcgaagagcctaacagaaggtgcggggcttgaaggaagcaaaagtttccgctgcattgtgttgaggaggggccgaagaggatgaggaaatacagtttagctgtttacagtctaaagtaattctccagtctttcataccatgtgcgtgaacacatgacctaattgtcatataatctgcatccatatatgtcaaacaaacgtaatgtgatcaataatgttttttgctttttcccactctagttgaacgatgatacaaggtaagactgtatttgtttactcatatcttataatctctaagtcattgttaacctaaaattatggcgactttggcagtattgtgtccggatcgtgtcttaaattaattaccattatcactccggggctcccttaatgatacaaccttgaactttggtttctgccttacctcctattcagttgagatatgggataaacatcttaataagcattatcataattgttgcgttttaggggtgagacagagcctcactctgtcgcccaggctggagtgcagtggcgcgatctctgctcactgcaacctccgcctcccaggttcaagcgattctcatacttcagactcccgaatagctgagattacaggtgcccgccaccacacccggctgtcttttttttttgtacagacggggtttcaccatgttggccaggctggtctcgaactcctggctcaagcagtctgcccacctcgacctccccaagtgctggaatttcaggcgtgagccaccacacctggccttgctcagtgtatttcatgttctgtctccccttaaatgccagtgagatatcagtaattttcttagtgacagagagcatatacgtttagaggcatttccccattgatccattccttcacgtaaattgacagtgacattgcctttcctcctgatggacctcagtgatctcagagatccccagtagcttcaatacttgacgtggtgaaacctttcggtaacattttaatttaaacttcaaatcataccatagtatacttctcaagcccacctccttagttcccaggattccaggaatttagctttgtccattataactttatacactcagccacttgtgcatgtgtcccagattgcttctaacagatagagtgcagctctagcctcaattcagtttccctcctcttctttggtctctgctaagatttcattgcaaaaacagttaatcctgttattttgctttaattcctttttatattccaaaccccacttcctttttttttttctaatttattcccagtaggagtgactccaaatttgcatatactggaactgaaatgcgcacagttgctgaaaaggtatgtgtgctaaaattttgcatgatggaaacttgcagttggggaaagatttctgtaatccagtgatctcagccagagtatgcggtttctggctggatgagatattctttctagtaaaatcagatgaagaatctactcactaggaatgggacctaattttctgttctttgtagcaaattgtctctacttgatcaagattaataatcactgtcagtaccaccctcttgctgctctccttgctgtcactgcctgttttctggcccttctcccactttccttgatactttggcatccttgatactttcacatcactattacctctttatctcgaattccaacatctactcatgcagccctctcttcttaaacaggcaaactgaccatagcatcatagttcttagtctgccttgacttttttcctatctgcactcctacaccatcttttgtggcatgctctagccttgatggtctagtgtaatgcttctcacctaatcgtggtatcggaccagttaacgtttcccccagtctgtcacagaccgatgcttttgtaaaatacaaaaaaaatgaattacttcccctcctcccaccaagttatcaggccacaccttcatctacttattactactagttacaaacttctccaccttaatcactttgcatctcttcccatatcaaagaaataagtcctcttcctatccaaagctgcagcttcttcagagaccttgtttatcaaatgttctgtctcttttctgggtcttctccctgtcacctggttcttttaggataaacatatgcttaaattactctcattttcagaaaggaaagctacttcttaatcccgtatcttcctgtagtcagtactcttatatccttcctttaatagccagacttcttaaaagaatgggctacaattactactccttcaccttccccagtcaaacccactgaggtctggtttctaattctaccttcggtggattatttcctggtgcttatcttcatctttctccttgaatctctaaactctcatgagtttttgttggttttgttgtattgcctttattcctgtttcccccttcccacaatcctttgtggactcctcttcctcctctgtctatgcattaaatattactcattcctcttaggcactgaaatctctgactaaagcaagaaagagagaaagaaacaattcaccctgggcatcagttactaagatacattccaatcttaataatgtaattttattattcaagatttcatgccctcgtcttgagttttatgtcagtttgtactgtctaaattagatattaaactttattagttaagctgcctttttagtgttgcatagtgtattttttatccttttatttttagcctttctgtatactaatatttaaaatgtgtctcttgtgtctcttattagtggtaaatactttttaaaaaatccagtgtgataatctttttaagtggagtattcagttgaaaaacaaaacaaaaataaaccacaaaaaaagaaatatcatgtgagccacgaatgtgatccatatacataattttaaattttttagtaatcacagtaaaaaggaataaatgaaattaatttgaagggtgtattttagttaacctaagtatctgaaggattattattttaatatgtagtgaatattaagaaatgttgagatattttacattccttttttctcttttgtgttgtctttgaattccatgtgtatttcatacttgctgcatatctgaaatcagacctgttgcacagtgaaaatctatagcttgtttcaaaagccttctctcagatttcacccttgtcccttcaacatctgataatgctaagcccactctttcccctggcccttcttgttcttccccacactaaatgtggccactccccttgattcaggccaagacctctgctccctttctccacaccttttttgtccactcataaatgctttattgattcctgcattgatgctgtttgagtctaagctataatcccacttgcctgctaaaaattgccatattgtatatctctcatcccagattatctcatctgaaaacaagctcatcttctttccttcctgaccctttctaaacttagatctgcctcacacgttctacctagtttcaaccttgaaactttagagtcctctttgaccgtttcctgtccaccatcacccatggtccataagctaccaaatcttgtagattcattctttttaatgggtctcaaatctgtttcttccatctctgccatctgcttagcccagtacttcattgttacttcatgtacagtttatctgaaataattttttttccttcgagttcatcctgcaaattatggcttggcatttgaggtcttgtacattctcactccaactttcttagctttgccatctgccatttcacctcaagctctgtatctaaatcagttgggtaagttgtctcccagacacctcattcacactttactacttccattcggcacctgtagaaaatctgttccccccacttcccacaataatcaaggaatggatacacttgtctgccttttctatgaagatttttttcttttttagattcatattctgcttatgtaaaagattacttttctaatataagtgagttctttcctctgagctcctgtattagtctgttatcacactgtaaagaactctctgaggccgggtgcggtgggttatgcctgtaatcccagcacttcgagaggtcgaggcaggcctgaagtcaggagtttgagaccagcctagccaatatggctaccaaaaaatacaaaaagccgggcatggtggcgtgtgcctgtaatcccagctgctgaggaggctgaggtgggagaatcgcttgaacccaggaggtagacgttgcagtgagctgagattgcactactgcactccagcctgggcgacagactgagactgtgtcaaaaacaaaaaaacaaaaaaacaaaaaaaaaactccctgagactgggtaatttataaagaaaagaagtttaattgactcacagttccacatggctgggaggcttcaggaaacttatgatcatggtggaaggtgaaggggaagcaaggcatatcttacatggtggtaggagagagagagagtgaggggggaagtgccacacttttaaaccatcagatctcctgagaactcactctcacactattatgagaacagcgtaggggaaatccacccctacaatccaatcacctttcaccaggtgtctctcctgatacgtggggtttacaatttgagatgaaatttgggtggggacacagagcccagccatatcagctcctatggcattgacttactacattatcttagtggagtttcatgaatgacaacttgccactcaaccatgtcgttagcacattgaaccctttgtcagtgctctgatttatattcctttgtgcaatacagtgttttgtacatagttgtaagtcaaataattactagttgatcatcctaaaagtccttccttgatttaaatattagcatatatattttatatttttgtgtctgaaatgtatatattgaggttgggtgtcttttatttgaaacatttcattattcgtgagaaaagtgtcagttttctaaaatggaatattttatctgatattataataaaatgcaattctatagttgaagggggatgtgttattggagagagctgtaagtaaccatttctgtggattttcctttaggttgatgccgtcagaattgttcacattcattctgtcatcatcttacgacgttctgataagaggaaggaccgagtagaaatttctccagagcagctgtctgcagcttcaacagaggcagagatatccttactggtcaatagaagcttttatgtgctctggggttcctgggccgcattgctgcttgctgcagtcatcctgctttaggtggtttcacaagttttcttcccttagatccaattgtttggtttttagaatttctctctatttctccttttgagtggcttttattggaagaattagaaattttctgacattcctgctcctaaatgccaaaagatctcagggtcaaacactgcgacaatgaactctgtgtggagtcccctccatcttcctccctagtcttctctccattcctccctgcccctccttccagttttcctagtatcatttaatttctaggccatttactatcttggtctctatcctcttgagagattctcttttgtgacttcctctcaaaaaatgcaatgctgggaactgaatgcagtgtttcatgttacatataaccccaaaatgatcaaatggggcatttgtttcctgtgatttgtttcagtatgattccgagtgtcctggccggcgcctcgtaagtgaatatgaagctgatccccatcccacttttgttttcttcagggatcctttccctggcctctcgtagtttcctcacatgcttccgctcatcagtgatctgctgaatgctcaagtgggaccctcaagtgcagatatgcaggctatctctctgcagctctcctctctggtcctctgccctgcaaacttcagctgcaattactatttgttaagcacttactaggtgtttgccaggcactatgctaaacaccgtgtgtggattattgcacttactcttcactgctctgaaacattattcccctgcctcagtctgcagctgaagaaatgggctaagagaagttaagtagtttctcttggcatttgaaaacttgaaaatatatcttagaaatattgtttctcagacttagttgtataaaaaggattattatattttaatataaataatttgcaggaaaactaatgagcattttacaggataacagcagcagtcttgaaagtgacaacttctgaagatttagaaaagcttttcagatagcacagtggtaaggattcgagtgatgaaacatcagctaaattaaacttgaggatgtaagtatatatggcattggaaaccatgtggattctagtttagaaattttggctttaaatgggcattatgggaaactcagcattaatcttatttcattcttttgttgccattaaattgtaataagcttattttaaacttcagggtgctttctgagcccttattagcatcataaattttgttcccacatttttaaagtaccttgacagacacacaggttggctgaactgacaggccgccccatgagagttgtgggctggtatcattcccatcctcatataactgtttggccttcacatgttggtaagtatcatggggttgcaatgtttattgttttcagaaattaatatcatgtttccttttccattacatagggtatggttattttaaaccaaaatttgactgtcctttagcagatgtcattattttgatttattttattatgtattaaaagtaatgatttatgtcatattgattgtttttaataagtctgtcagttgatataaaaaaattaaactgttaactgaaaattgctgattgctgaatatcattactgtccaggacactcccattctgcagacttaaagatattaaagggtaaaatttgcaaaattgatttttacagttgctgtttacgtatagtccattggggctctcaatatacatctttacccttctaatcagtgtaatgtaactaaattgctttctttctacctttacccctttttgagaatcatggtgggtttttttgtccgtatctgcgtctccagaaagaaggagaataacttggggagagtgaactaatattcatgagcacttaactatgtgctaatggtttacagatgttttcttctctaatccttgtggcaacctgtgagttagagatcttacccccattgtacagaagggtaaacaaagactcacatgaattaagtaagttgcagagctgaggttagaacccaggtctgactcccaagtctgctcttcccactgtgctactactagtcatatgggtttgagttgatagcaagttatatattcatctacactgtgatacgaatggcaaaaagtcatcagtggtacagtcccagactttaatgaaacacgagtggtcctaagaaatacagtattagttctcagtcttgggtgggtgaggatgtttctcagaatcacctgagaaagctttcataaaatgtgcctgccccaaattaatctttcctagaccctaactcaaacctactgtaacaacctctgggagtaggtgttaggtggggatattgttgaacgcccctagttaaatactgatttagaataagggagatgacagatctaccttctcccagatttgccaaactttaacatttggcaacacttgctgtatcattctcttatacatatatgtatatacgtgtgtgtgtctgaagataattttttcctgaagtattagattaagttgcagacatggtaccttttacccctactcttcactatgaatttcctaaacacaaagaaattctcttacataaccatgatacatttataaaaattgggaaattaccattcatataatagtattatttaaattacagaccttattcagattctttaattggttcactgatgtcccaataaagttgtttttataactattaatatattcctgtaaagccttaatgtcactgaaaaaattcagtggctgatttgttttcctgtcattgtcaacactgaaatcagattggcctaaaatttttcccatggtagtgccatcagccactaatgaagaaaagtttgacacatatattactgaacaattattttcactatagtaataagttacaatgggaaataaatacataaaatttggtggtaaaaagaaattccctacgaatttaaggaaaaataccttataagtatctgaagcagagcacccagaaaatttcagagttcagagaataattgaattctctcaggggagaagatctgagccattaaacaagaacccaggtaggagtttgtaatgcagcagtaacagtagtgggaacatttcaatctttatagcagtcagaaaaaaaaaaaagggatactgcagaaagtaactgaaaaaaatcaactctaaattatgaaatgattaagaagccatgtgcaaataattcaagacaaaatagatttggagtccagagtatagatatcctacctgaacaagaattagaatatgcaataagggctatgtgtaaagaaagtttagagagttaccatagcatgagggttgggaataccagctttgatttagttggagactaggtctgtgttagcatcttgtttcagtcacttactagttgagaaaatattttaacttgtctatgcctctgtagtttcctctctgtcagaaaagaacatagtctcagagttaagagtagtatatgaaaatcatgtatacaacaccttgtcccacacttaccatggtagctgttcacctataaaatgagcaacaaaagaaagacaccaaagcatttatttgtaaaactctcaaggacatggagagagtatatgaaatatctatattgaagggcagacaatattcaaaggattaacaatgaggacacatcaggtctctcatttgagatcctgagatctcaaaaatatttacaggccgggcatagtggctcacgcctgtaatcccagcactttggcaggatgaggtaggcagatcacttgaggtcaggagttggagacccacctggccaacaaggtgaaaccctgtttctattaaaaatgtaaaaattagacaggcatggtggcgggtgcctgtaatccaagttactggggaggctaaggcaggagaattcacttgaacctgggagatggaggttgcagtgagctgagattgtaccactgcactccagccagggtgacagagcgagattctgtctcaaaaaaaaaaaaaaaaaagtacagtaatgaaactatgggtacaactaaagaaaaataattgcccaactgagctggcattcacactcatctccaaacagccttttaagaagtagtaccttataaatgtatgcaattatgatttgtcaattaaaactagtatttaagaaagtaaataaatgggaaaaaaagaattgagtctaacagaggcactgtattgcattacaaacctcagaaaaagtgagcaatgaataaaaactaactacctttaacaggaaaagaattccaagctgtggtaaagagtgacaagtgagaaagtgaaatctttttttctgttaaaggaaaggtataattttagttggtgagggagagtgacgtgaccatttcagtgctttttatgataaggtaattagtgcaattaggttaagttccagtgggctaggtaacactgttttgaacataatttaaagggatcattccataaaacgattcttcaggaaatttactggatacctgtatggaataataaggtcatggctcctgctgtcctggaccttaatgattttgttggggggaaaacagagtactaaagggaaaacaatgagtaacatgataaagaagaaatgagatgtagtccatatagaacatttgtacttgtaaatataaacaggggaagcatctataaaaataaaagccttgggattaggaaaaaggaagaataagatgttactaagacaagctgcaaacctaaagacttgaacaaaaactaacaaactaggttaagctgtatggggaaaataaagagcagccatcatcagctaaagggtaagtgagagaagataggtcatttattctataacaaaaggcatagtaactaaggaaactctaatgaggctgaattatgtgccctaccgtagcaacatacatgtacacaggataaagttttacatgtaaggaatggaaactagttgagatagaagaacttgataacccactttcaaaatttattcattccttcaaaagaacataaagtgagttggccttcggttgaggttggcagtggagcgtggaggggacagtgaacaaaagcaagggtgaggtaggacaagcacacacacaaagactttaaaatttcatcttaaaagaattttattcttacagaaaaatttcaagaatagtatgaagaaccagatgcaacaattgttaacctttggtcgcatttgctttatcatattctccctccctctccaacatacacacatgcacatgtgcacacatgctatttgagagtgagttgcagacatgatgctcctttacctttaaatacttcattgtgtatttctcaagatcaagggtatttatttacataaccacagtgcaattgtcaaaataagcacatttaataaatacgatcatattgtgcaaactacacagaacttattcacattttgccagttaactcaatattgtcctttatggcagttttttctttccaatacaggatccaatctcagatcatgcatggcatttagccttcatgtcactttagtctcctttcctctggaccagctccttagactttttttcctctttcgtgacatagacattttaggagatggaatgttgctccatttgactttgtctgctatttgcttatgactagattcaggttatgcacttttggcatgtggtgctaggcctttgtcagcgtctcccatctggacgtgcgtgatttctctgcctcaaactaacattttcatgccactgatgaggcagaattaacaaatgtgagtcaaatgggaagaggtgataacaagcctcttctcagcctgtccatttgttgaacagataccgaggacttggccatgccaatttgtaataatatctgcaaagccaattccaaaattgggaagctgtgcatgttccatgatatctctgatcagtatgctcctactttttgcaaaggcaaaccctttcattttcaaacctctgaattccccgtttctgccttcatgttcagcaatgttatctaacattgcttcccactttaatagagaaaacaggaaccattagaaaggaatttcatctgtttctcttgattcacctacttgtcactgtgcctctcttccccttttccctcctattttatctttgcctcctacattctcaagaaccttactctgttttttatgcccctcttttttacacatctacatactttgccactatactggattcttcccattattatttctttcaacaaatttgagtgtctaccatgtgtcaaagtgctgaagataatgaatgagagaaacacggtccctgccttcatggagctttcaaatatgttcatacttcacattgaggaaaacaacaaaaacactctagtttggcttctattaaagtggatcttgctagagtcatcaatggtatccatgttgaaaatctagtgaccattttaaaatcccatcttataaaacattgacactgtcaggtactctctacttattgaaatacttcccagctaatcacgaggagtgtgtggcttttgggggaagaaactaagctgagggtcagagctgaaatacccagtccaaaaccagatggctagtaagcagcagacccagtatctgaattgagtttatatgagtctagagcctaggatttctacagcatctcactttgattgaacaagtgggaatcctattcatggaagtaggaagtggaggaggaaacataggtttggtgatggggaaagagatatagttcagttacatcatacacacacttaacgtacctgaattttacctatacagtacacgtttgcaaaagaaaaataagtgatttaaatgctgcagactatttcataaatctcccaagacttggtactgtttgtagaagttattcttttatattcattttattttacttgtaaatgcttatccaaggagacatgtacctgtagttatgttcctcattttaagatctgctcaatttttttttctagcactacggtgagttctaatatctttgtttaaaaagttttttttttgagacagagtctggctctgtcgcccaggctggagtgcagtggcacgatctcagctcactgcaagctccgcctcccaggttcgcgccattctcctgcctcagcctcctgagtagctgggactacaggcatccgccaccacacccggctaatttttttgcatttttagtagagatggggtttcactgtgttagccagtatggtcttgatctcctgacctcgtgatccacccaccttagccctccaaagtgctgggattacaggcctgagccaccgtgcccagccccaaaaagtttttttaaagtaggataggccaggtgtagtggctcctgcctgtaattgcagcactttgggaggctgaggtgggatgattgcttcagcctgggagttcaagtccatcctgggcaagatggcgagcctctgtctcttaattttttttttaattagccaggtgtggtgatgcatgcatgtatttccagctactcaggaggctaaggtgggaggaacccttgagctcaggagttggaggtggcagtgggccgtgactgcaccactgtgtgccagcctgagcgacaaagcaagacctcgtctcttaaaatttttttttaaaaagtaggatatgagaaatagtcaattattttcagatatataagaacatttccaatggcctccacatgtaattttggaaagataggctggattcagagcaggtctgccacttcacaggaacattttcaccacgtagctcctaaaaggaaatgagaaggcctatttctgaaatgtttccatgtccccttggggggaaaacagtttcagttcattcctccactgacattaaaagagaatgtctatttcaggcaagaataataaaatgggcttttaatactacatatggttatttcatcatatttcttaggaatggtgctgtgtaatatcactgtgcacaaaatcacagattcttcaagaaaactgtttcttaaatacctgtgtaattgcccacaaaggggcccagtgcatgtgacattcagtctaacagcttaaccagctctctgccgtacttgccatacagaaaagctgaaactgctggtttccaggtcagtttatgtggtccaatccgtaacctgctttcttcctgaaagacccaaccagaggaaactgaccaaaagagcatctctcgtgtaccaggcctgagttcaacagaaaacagataagcgacctccaactttttatccctgggtctgaagtcacatcctgaagagtttggttacaccagtaatgaaacatacatggtttcctgttgctttcctttcttaatttccggtgaggataatgtcaccagaaagttccatctccctctctcagtaacagggagaagtggaacaggcaattggatctcaagcagggtcttggcttgagccttggggcggtttacagagtttctgtcttgaccacggagatctttaccaatttgctgggtaggtccatggctgcctggttcccccaggactgctttgccatgacagctacctgaatgactccgaggaactgctctttggtgatttcaggaggttctttccctttaagggttcttcagacaaaatgtctgaagcgctctcgatatgagttttggtagcggccagcctgggtctgggagcagagtgataggacgtaccctgcctggtcatgcccaagggattctgattattcatctgcaacacaccttggaaatcatgaacgtcccgtctgtggtcacagctgtctgtccagtgctggctgacgtccaagctaacagccgccccattgggaaacttcatgctgatcacagtggcatctgcatcctttaaggaggccatatctggtcagaaggcatgtccgagagaaagcacagtgtccagagtggcttttaacagcaacatgcatgcgatgtccacattgtgcacccagtcttgtagagaaccccacctgcccgcctgccctcgcttcctccctccgtccctccctcccttccttgcccaggctggagtgcgatggcgcgccctctcaggtaactgcaaccgccgtctcctgggctcaagcgattctcctgtcttagcttcccgagtagctgggatcacaggcacgcgccaccacgcctggctaatttttttttttttgcattttgagtagagagggagtttcaccacattggccaggctggtctcaaactcatgacctcaggtggtctgcccgccttggcctcccaaagcgctgctcacagcgccatctggtggatccttttgtaagcttcctcaaagcaggactgggcagtggcctattcaaagcacgcagcctcgtgcaaagcacccccatccctgttctcgaattaccctagtgttggccaaataatcggctctgaaggttcactccactttatatagctgatcgtcaaaaacatacagcaagcagcagccgttcttatccattatatcccaaagatggccaggctaatgctccgatgtcattaaagcatctcatacctctgttggaggcttctgaaatgtctttggctgttctgagggcaccaatgggcttttcactcagagagaaggaaaggctgagaggtggccagcagaggtagatagcgttgtgtttggacggaagcagaatgcctgagagaatttctgagtggatgctgaggggcaagggcgagaggtgcagggtccgagcctgctgagatgagaataagtgtccataggatgacagctcctcgcgggcagcggtggctggagtgggtccctcagcgctcaggtggtctcccaaggggtagacaatgctcagagggggtacatccattaggacgggatgccagaacgatcccacccggagaagcttcgccggcgagaagaatacgccttcccacaggggaagatgggggtacgagggactcccccggaggggtgaccgaggccagtctgagcctctgggggcccaaggttgggaactcttggtagccagtggacgggcagggtcggctcgctttggcaggcgccagggtggaggtactgagcttacgtgagacatactctcaggagcattgttttaagacaaccaagttgaactgtcagacggcaacttagatctatggttctggagttctgggactagagtttgttgggcaagagttgggagtggctggtgtagatttgaagccacaaaactagataaaatcccccaaagggtaagggtagagagataaaaggactgaacactgagcctgggccacaccaatatttggagagtgggaagatgagaaggatccagcaacagagacaggaagttagagacgagtaggaagagtgggaacgtgaggcaaagtgaagatagtgtttcaagaagggagtgatcagctgagatcaggtaaattgaagaccaagaataaatcattggtgaccttgacaaaaagcagtttgggtaacatgatgggcacagtagttgttaccagtggttgtagataaaattgaatggaagtaatgcttatgaagtacctttgatgtgtgttaaaaattttgcaatttaaaaattacaaaaaccctatgagagaagcgatgatgtttattctcatttaactgataaggaaataggcttaacagtaccaagaattttacttttagcaatttactttaattctctgtactgctatagaccgttttacaatgctatgttcttttagcaatattttcagccaatttcctttgtactcattgctgggtactgtttggtctcagtctttacttaggaggacattggggagaagtcaaaatctagatcaaaaaggtatacacacaaagaatgttgaagaacagattgccaaaataagtgaatgtaagccattgggcaaaactgtaatctgcagtgtttcattgtgacacctgatcttttgtatcctttataaacaatggtctgaagactaaatttagcctctgtttagtttttggcttttttttttttttttttgagacggagttttgctctcgttgcccaggctggagtgcaatggcaccatctcggctcactgcaacctctgcctcccaggttcaagcgattctccagcctcagcctcccaagtagctgggattacaggcatccgccaccacacccagctaattttgaatttttagtagagaaggggtttctccttgttggtcaggctggtctcaaactcccgacctgaggtgatccgcctgcctcagcctcccaaagtgctaggattacaggcaagagccaccacgcctggccgtttttggcatttaatattttaatcctttctaatgttgttatttggtgcctgtttattatctcttttcaaaagttcagtaaccatatcaagcagaattaagaaaaaaatcaagtaaccatataggaggggtttctactctctggaatgttgaatttatatcacaaccacttccatacaatggcttcctgtaagattttcctctgtaattgttccacacttctattctttagtagcaagcctaataaatatgttcactttcctagaagctgtccatcaaaaggctttttctaggaaatactttctctcctttttaatttctctttctattaccacattccatagcagagctactcttgggctaggcaggctagagttattaataagttttattatttaatggcagactttcgatagtattaccctaacctagcaaaacatttttactttgatattgtccttaggatatattcctgttttgcctgtacaatctgaatcctaggaagattatatgttgctgttatctttaaatctttaagtcaatctttaaatcaataagctgtgagacacagcttattgacagaagatttttaaattttcatttattttcagatgttcgcacacaagccatgtaccagatgatggatcaaggctttgtaggacttattttttcctgtttcatagaagataagaacacaaaggtattgtgtgtgcatgtgtgtgtgtgtgtgtgtgtgtgtagggtctgtgtgtgtgtctacacacagagtagagaaaaatctctttgcgattttaataggatggtcaggaaaggtttcaaggaaaagggtcattgagtcaggacctgaagaaggtgagggaacaagtcttgtggatttcttggggaaagaacgttccaggcagaggaaatagccagtccaaagaccctaaggtgagtgtggcatgttcaggaaacatcaaggaagttggtgtggctgcagcagagtgaggaagaccatgaccatacatgccagtttgcctctgtcagtcccagttttaccctattatcctagtgaccttccctcttggaagtgtcccagtttgaatgataactcatttagttgtcctaaacaaggtccagatcttgtaaggccttggatttgactctgagttgggaagtcactggaggatgactttatgttttaatgggatctctctggcttctgtgtagactgaacagtgggcagagggtgtgggtggaatccgtggcatcagtgaaacctgttaggaagatattgctgtaatctagacaagagatgatggaggtttggtcatggaggtaagagtgaagataatgagaagtggttggatgctgaatatagtttgatggctactaatagtaacaactaccatttatcacctattgtatggcatgtacttattaggtgctttacgtaaatatgctgtaaccctgacaaaaacccagaaggagtattattcccattttatgaatgaacaaactgaagctcacagaggttaaacagtttgatcagtggccagtcttgccattctttatttggattctgtttgaattttatgttcatgtcaagaggttataatatgtgtcagttcaaacaaaaagaaaattactacttaacattgtaggtatgaattctgctaagaataccaatagtgtcttatttagtgcattagttatattctcagaatctgtgttaataatgaatattttccataaaatcagttttccagaaacactaaagttcagtaccttgaactttatacatcatttgaaatgctttcaaccttgtcatcatgcgtttatttatttattgtcatcataagtagttgttgaataagtttgtcagctttcaggatggcagtttgaatgttcaggttcttaggttcctggttcttgtgtttgttaacaattccctgctgttacatgagcagatgtttggttgtgaccatcttatgttgactgagcatatgatcctttttatagaaattaatttatggcatattccatctttggtatctcttttaacattctgcttctagagggacctttggggtctttttcaatattaatctttctttgtgtgatatttctttctttcttttttcctttgatagactggccgggtactctacacttgcttccaatccatacaggcccaaaagagttcagagtaagtatgagagagacttatgtgtgtattggagggctaatctccaattcagagaatttattgttttgtttcattttattcctttcactggtaagacactaagacactgcatttttatttatactcatttacagctctacgatgagttagaatctctttagcagcttggatactggggacctaggaagctagggtcatatgagcagtctcttcactgtaattacatcaccacagtcctgcctgacatttccttttgtacacttatcctaactgagctgctatttttcctttctctggtaaatcataaatcaaagactgaacatgcagagtactagatttgtatagattcttgtctttgctgtgtcataaacttgatttaaatgtttgcatagatccatttccttattgaaatccaattcaatctaaattagcaaatctttttttttttttgagacagagtctcactgtgtcacccaggctggagtgcagtggtgtaatcttggctcagtgtaacctccacctcccgggttcatgcatttctcctgcctcagcctcctgaatagctgggactacaggcatgtaccaccacgcgcagctaatttttgtatttttaatagagatggggtttcaccatgttggccaggatggtctcaaactcctgacctcaggtgatccgcctgcctcggcctcctaaaatactgggattacaggtgtcagccactgcacccggccactagcaaatcttaattgagtacctactatatgccatgttcattcattgtctaattgggagatagaagcaaatactgtattgccttttttcttgtcatatttatcaatttattattatagcattgtttgaaatgtcaaagaattgggaaacagatgctcatcagtacagaactgattaaataaattataatacattcatataatggaataaaatgcagccgttaaaaaaaaaaaaagcaaggaagcttggtagtaatacacaaatatctccaagatattttgttaaatggaaatgcagggtagaagaacagtaagctatgatttgtgtaaagatgtagaagagaaatagataaatacctagtcaagaaaaattaatttttaaaattttcaccacactaatgcatgcatatgcatgaaaatattgagtggtacagaagggcttataataaatagtttcactcctcaaatggaaccacttctttctccttattttccttttagttcttctgttactttgatatctctaaataatatacttatgatgttctttcttgatttaccagttttggatattttctattcttatttattattgtgttatattgctctcacaaatgaggatttagctcacttatactaccccatctccattctcctcaatgtagttatgttactattttttgttctgttggttacttttctaatcttaaagtttgcttatttattctattaacaattgacagtagacaatattttttggctccctgctgttacttgtagttttaccctaagcatttatattttcacagttgtaagcatctatgttctgtgttgtaaccataattgcattttctgtgctttgtctatggttgattctgagagtagaaaataaagtgtttatattgttattattatgtaaagattattctctgtacaaccaagcagtgtagtgtactatgattccacttcctttcttacatagctttttgttttttacatggggttttgagtggctttttccccttatttttctgcctttatcatctcccagagctctacatcctcagaagtaatattaaaatatttggaatccttgcttttcctaggattgctcccttgaaacccactatcctcttaccctgatctggtatcttctctaggcctactgcacagctgacattctgggactttccttcattattctcctgggttggatccattgtcacctggattttatgttatctttcttggttcactgtgtcattttgctggaaaagactctctagtaacttcctaagaatggtgtgtatttcagctaaactttctgagttctgcttgtctgaaatgtttttattcttaattaataaccttactagataaagaattcaaagtggaaattttccccctcataactttgaaggcattgtttcattgtttttaaacatccaatgttactgatgataagcctttgtagggcatttttttcccttctctgacagcttttaggtatctctctttattcttgatgtgaaattttctatgattttctaactatgatatagttagaatgtggatattttattcaaactgctgtacacttcaatcagaaagtgcttgtctttcagctctgggcaattctctgttgttttttgtttgtttgttttgtattcccagataaaacaatccacaacctacctagttcctggagagaggaaatcttatttgtaactcagtccaattccataatttaaacagtttcttctagtttatattggtctttggggaatgacttctcattccttcaattacttccgttactccccatgttcactctaagatggcatcagaagtattgggaagatgacttaaataaaactacactgtaaggaaaggaggctttctagtctcatgctggttatggtagtcagtgtaggagtccttgttctcatggtcagtgttctccttaatttatccaatagaatcctgtctcatggacttgaagtcctagcagaaggagatgcatctctcacttcaagtccatgagacaggattctattggataaattaaggagaacactggtgatgcttcctctctcacagctctctccttccttttccccctaagttaataggacagagatatcatatccttttctctattctttgataattcctccctgtttttttccctttctttttctagaactcctatcagtcacaagttaaaggtcctaaattgacctaatgactctttctttttactcatattttctgtctcttttattttgttctagtttcggctttttaaaattttatcttccaactcttttattttggcaattttatatttttaattttcaagagttttttctacatttgctggttactcccatttcacagcatccttttttattttattgatatgatattgaaaatgttagattgccttctgttttttacagttacctgtttcctctgataatttttttttgtttaatttttaaaatcttccttgtctatccctttttaagaataaagcaacaaaaagtgaagtggtagctcattatttgtggccttggcttgtcaacatgaggcttcactttacggtgaataggttgggagccagctcttttgttcaggtatcactctgttctagacctgagatatcttgctgtgggacaccagtcttagccattgctgtcatacttcctcccagacagtttatcattattattgttatcattattaactattaattagaagaattcttgatgctgctgttactgcaaatgataatgattattattattattattttgataaaagaatgaaagcttggttattaaacatttggtgtatacgcaggccaaatcatgaaggaacacaagagagtagctagagtctcattgctggtaggaggaacaaaaggggtccaagaaatcacataaagggaggaacatgataaagcaacttcataaagttgcttataaatttctgggctaatacttgagcaatgtatgcatggatctgatcctaattagcataatttagaacagaattaaccaatagaccaccgcatagatcctatactgaccactaggtggtgcacatgcaggtatgatccaaagaacactacaaaggctctgaaaaattagaaccgctgcctacagaaggctgcggaaaattgaacctgaacctaactaggtggattgttacaaaagtaacaacattctccatagaatataaacaagacccagcgtgtcaacataatattccaaatactgggaatccaattcagaattacttggtatgtgaagaactgagaaaatttcaacttgcatagaaaaggacattaacagatgccaacactgagctgacacccatgtaggaattgtgtgataaagactttaaagcaaatacagattgagtatcctttatatgaaatactttcagattttagattttttaagattttagaatatttgcattatacttactggttgagcatccctaatctgaaaatatgaattccacagtgctccaatggtcattttctttgagtgtaatgttgattcttatagaataagaatataaagaatgagaatatttttgtatagctgtacagtgtgttttaagctaagtgttaccagattcaaaatattaacaagtttataaagtaaaagagttacggttaattattgaagaaagaaaaaatttagtttttattgttatttatttatttttttgtgatggagttttgttcttgtcacccagactggagtacaacggcaggatctaggctcactgcaacctccacctcccgggttcaagtgattctcctgcctcagcctcctgagtagctgggattacaggcgtgcaccaccatgcctggctaatttttgtatttttagcagagattgaatttcaccatgttggccaggctggtcttgaactcctgacctaaggtgattcatccacctcggcctcccaaagcgctgggattataggcatgagccaccgtgcccagccaagaaagaaacaatttttaatatagtgtagcctaagtgttcagtgttataaagtttccagtagtgtacagtaatatcttaggccttaacattccctcaccactcacttaattgctcacccagagcaacttccagtcctgcaaactccattcatggtaagtgccctatacaggtgtacttttttttggtcttttattctgtatttctactgtaccttttctgtgtttagatacacaaatagttgtcattgtgttacagctgcctatggtattccatatgataacatgctgtacaggtttatagcatgggagcaataggctataccatatagcctgggcatgtagtaggctgtaccatcttgtttggtataagtacactgtatgatgttttaatgacaatgaagttgcctaacgatgcatttctcaggacgcatctccatcaataagtaatgcatgactgtatatccattcgatcaaatattattcataaaaaagaaacaaagtatagaagcatgctacaatctgaaagaatttgaaaacataagtgaaagaagccacacaaaaagtcacatattgtgtgatttcacttataggaagtatccagaatagctaaatccatagagacagaaagcagattggtgttatcctgggctggtgggaaggaagaatgtcgagtaactgtttaataggtacgggattttattttggcgtgatgaaaatgtttttgaaccagatagaggtggtggttgtacgatattgtgaaggtactaaatgccgctgaattgttcactttaaaatggttaattttatgttatgtgaatttcacctaaattttaaaaaatgtgtaaaaggattttaatggacgtttttccaaggaagatatacaagtggtcaataaacacgtgaaaaattgccccaaatcattagtctttagggaaatgcaaataaaaaccacaatgagacattacttcccacacactactacccaatgtcatctacagatccagtgtaatccctatcaaaattccaataacatttttcacagagatagaaataaaatcataaaattcatatgaaactacaaaagttcctgaatagccaaagcaatcttgagaaagaagaacaaagctggagaaatcacactatgtgatttcacagtatattataaagctataataatcaatgcaatatggtactggcataaaaatagacacatagactaataggacaatagagagcccagaaataaacccatgcttatgcagtcaactaaccgtcaacaaagatgtcaggaatattcaatgggaaaaggatagtctcttcaataaatgatgttggggaaacaagatacccacatgcgaaagaatggaagtggatccttatcacacgtatatacaaaaatcaagttaaaatgaattaaagacttaaacataagacctgaaagtgtaaaactactagtggaaagcagaggaaacactgcttgacattggtcttggcaaagattttatgaatacgactccaaaagcacaggcaacaaaggaaaaaagaaacgggtgggactatatcaaactaaaacgcctgcacagcaaaagaaactgaacaaaatgagaaggcaacctacagaaggggagaaaaatatttgcaacccatatatctgataaaggggctgatatccaaaatatataaagaactcatatagctcaatagcgaaaaacccaaataatataatttataaatgggcaaagatcctgaatagacatttttccaaagaagacatataaatggccaataagtacacgtaaaggtactcagcatcactaatccgagaaatgcaaatcaaaaccataatgagttaggatggctattatcaaaaagtcaaagatagaaaacagtatagagactcctcaaaaaacaaaaaatagaactgtcatatgattcagcaatcctatttccaggagtatatccaataaaattgaaatcaatatctcaaaaaggtgttttaaaaaaccagaaaataacaagtgttggcaaagacatggagaaattggaacccttgtacactgttggtagaaatgtaaaatggtacacccactgtggaaaatggtatggtagtttctcaaatcaagaatattattaccatatgattcagcagttccactttttggtatatacccaaatgaattgaaagcagggtctctccatccgggttaacacggtgaaaccccatctctaccaaaactacaaaaaattagctgggcgtggtggcagacgcctgtggtcccagctactggggaggctgaggcaggagaaaggcgtgaacccgggaggcggagcttgcagtgagccgagatggcgccagagtgagactccgtctcaaaaacaaaaaaaaaggaagcagggtctctaagagatagttgtgcacccatgttcatagcagcattatttacaactcagtttcttagccttttttaaaaattctgcatttctctttattaatttattctattttctttgcattttattgttgtattctaaattcttgaggtgaaaaccaggtttattttctgtcttcctagttttctaataaatacatttgaggtcataaattttcctcttcactctgggcccacaggttttgatgtatatatagtaaggcagttctgatgttttttgtttgtttacttgtaaataatttgtactttccatttttattttctcttcaacccaagggttatttagaagtgcatttaaaaatttaaaattttgaaatttccagttgtttagacttgagggagggactagtatgttaatttttaacactacattatggtaactgattgtggcctgtgtggtatcagccttacggatttttaaaatatttcctctgttacctagaacaggggtccacaaactatagcttgtaggccaggttggcctggggcctacatttgtaaatcacgttttattggaatatagccacatccatttatttacatattgtctatgacccctttccagctatgattgtagagctgactgttgtaatagagaccctgtggcccacacagcttaaaatatgtctttacttcaagagtttgctgatccctgacttaaaacatagtcaattttcacagctttttcatttgggttgaaagtatgtatattttctcttgggtacaagttccttatatccccgtcagaataagcttaagttgtgttataccaatccttatatccttcattgtggttttgattattgatatctgagagagatgtgtatgtataaacttcccatcccaactaaattatttgtccactttcatattttagtcagagttagctttatatcctttgaagctgttttttgtttgtttgtttgttttagtgcagaatatttacaggtcataactattaaacttctctgtgtttttccttcacacaatatgaaatagtcctctttgtcctatttattttttatttatgccttgaattctttctctctaaataatattattgttcccgtcaggattaggttcagcagcatatattagaaaaaaaaatttaaataagaaataaaattagaaatgttttttttttttttttgtggtaaaagaagtctggagatggatatcaggtctcagggctctgcagtgtcatcagggacccagactcctctattttgcttcaccatcttggtgtgtggtttccatcctaaggtcccttcatggtccacgagacttctggagctccagccagcacatctccattgagggccagaaggaagaggaaaggtaggagggcaaaaaggggcctgtcccccagctcaactgatttccaataagtgaccttcccagaagtcccagaaaacaattccacttccatctcactggcagaactcagtcaagtggccatacctaagctgccaaggagactaggaaatctagtcttttacttcaagtagctctgtctttgctaaaaatggacattctgttatcaaggaggaaagtgagaatgcgcatttggaataggcagccagcaatctctgccactgcccgttatgtattatagttcttgttagcatttgtttgcctattataactttttccactcttttatttttgaccttcctcagttattttgttttaggtatgcctcttataaaatatagcaagatcttgagttttttggttttaagcaatcaggacattcgtctcttaataggtgaatgtcatacattcattttattaccattgctgacatatgtggcagtatttctgccattatgttttgccttctgtttgctatgcttttaattttttccccttcctgtcacttgcactcattgagttttctggtgtctgatttttctgttttaggaattgtccttactaaatcaatttttaaggttattactcgatgttttttaatattccgttttgaaataatattagatttacagtaaagttgtaagaatagtattaaggattcctgtatacccctcacccagattccccaaatgttggtattttgtcacatttctattgtcattttttttctttattgtatggatatttttcctgtaccatttgacagtaagttgcacacatgatacctcttcagtaggcatttctgaaagaacgacgacattctcttacataaccagaatatcattatccgtatcaggaaattaaaatccttacagcattattatctaatccatagatagtattcaaatgtcatcaccaatttttctaattacatccatataacagaagaaaaaacctttagtctggtcctggatgcagtccaagttcacacattgcacgtaattgtcttggctgtttagtttcctttggcttgaaacagttcttatgtcttttgtgacctaaacatttttgaagactactaaagggcagttattttggaaaatgtccttcattttggatttgttcatgttttatcatgattagatgtagattatgcacttttcgcaataatgccactgaagttatgttggttcttttggtgatttgtatcaggaggcacatgtcaatttgttccattactggtgattttaactttgaccatgtgcttcaggtagtgcctgatatgtttttccactgtaaagttaattattccctttgatattaataaacagttggccctccacattcatggattctgtttccattgattcaaccaaccctggatcaaaaatatttggaaaaaaactgcatacagggtgaacatgtacagacttttttctagtcattattccttacacaatacagtataataattttttttttttttgagacagggtcttgccttgtcacccaggctgcaatgcagtggtgtgatcacggctcacagcagccttgacctccaaggctcaagggatcctccctcgtcaccctcccaagtagctgggactacaggcatgtgccaccaggcttggctattttcttttttgtattttttatagaggtggggtttcgccatgttgcccaggctggtctcaaactcccgggctcaagcgatctgcccatctcagcctcccaaagtactgggactacaggcatgcaccagtgcacccagcctgtatgaggtattataaataatctagagatgataagtcatctagagggaatttaaagtatacaggaggatgaggttatatgcaaatactgcacccttttatatcagggacttgaacatctatggatttcagtgtctgtgggaggtcctggaaccaatccccaacagctacgaagggatgactgtatcttgtggggagttttagcattcatcaattagtatttcctaaattacttattactaagatgtttgtcacatggcaatgttctaattccatcattccttcaacatttactagttggtattcttctctaagaaagagttttctcttctgccaatttgattatttgttcatttatttatttatattaatgtgaacacctggatccttattttattcaatgagttttaatccattactatcattagttattttgaggcacccagtgtttcagaattggctagtggaagcttttcctgtgttattttgacctactcccatctttctttgattttctagcacaagtagatgttccaggtttgtctcattctttcctctacccagcctggattcattatttctccaaggagccttggttctttgtaattcttttcttccatcatgccctatcacttctctaaccacagaaaaccctgatctactattagtacagattggtcttcattttctagatttttttgtatatggaatcatagagtatgtacttttttgtctgtctcttttcatacatcgtaattattctgagattcagccatgtcacagcatgtatcaatagtctgtcctttttattacagaataatattaaattgtataaatattaccacaatatgtttatccattcacctgttgatggatatttgagttatttatagtttttgtctattacaaataaagctgcttagaacatttgtatataggtcttggtgtggatatatgcctttcctttccttggggaaatacctaggatcacactggctgaacatacagtagtcttccaaagtatggacatggtatatctctccatttatttaggtctttaattatctcagtaatggtttgtggttttcaatatacaggtcttccatatcttttgtcatatttatccctatacatttcatgtatttatattattgtaaatgtgattgtattaatttcaatttcctattcattgctactatataaaagtacaattcatttttgtatattgagttaatatcctacaaccttgctaaattcaattacttttaatagcttttttgaagggtccattggattatctacaggcgattatgtcatctgtgattaaaggcagtttcacttgtttctttccaatgtggatgccttctgtttatttatttatttttttgccttattgcgttgttagaacctctaataagctgttgaatacagctggtaagagcggtcatggtaactttgttcctaatctttggagaaatcatttactctttcaccattaagtatgatgttacctgaagatttttcatagattcctttaatcagtttgaggaagtttcttcaattcctggattgataagaaaatgttttcaacaaaaacagatgttgtattttgtcaaatggttatctcctttatagactaattagctgtagtcttttgttatttcagtggttgctttagggtttttcacagggtctgtcaacattggcactattgacattttgggtcacatagtttttgtgtgtgtgtgtgtgcgtgtgtgtgtgttgtcataatcagaaacatctccagacacagccaaatgttttctgcagggaaaaattacccctggttgaaaaccactagtttatagtatacatcttttacgtatcacagtctgtcttcgagtgatattttactagttcatacgtagtataagaatcttgcaacatcatactttcatttctcgcctcctggcctttgtgccattgtggtcatacattttacttgtatgtataagttttatttaaacagtttattatcttttcaagaaatttaaataagaaaagtctttgtatttaaccatatggttagtcatttctagtgctcttagtttctttgtttacatctggtatcattttctctcttcttgaagaacatcctttaatgtgtcttgtagtgtagctctgccggtgctatattcttttgactttgatatatctgaaaaaagtctttgccttcattttttgaaagatattttcgatgggtaaagaactctaggttgccttttttacattcagaactataaagatatttctccgctgttcaacaagaaagtggctgacatttttacctttgtctactctacttaatgtgtccttttttaaggcttcttttaagattttgtttttatcactggctttaaaccatttgagtataagtgtatcatggtgtaattgtttcctgtgcttgggtttcattgagctgcttggatctgtggatttatgtattttttttcatcaaatttacaaaaacttcagacattatttccactagttttttatgtcccactttctcctctcctttaggtgtttcaactaaccatatatttggccacttaatgttacctcacagttcactgatgctctgttcattgtttttcagtcttttttttttctatctgtgatttgttctgtatagtttctattgctgtcttctagtttactcatctttctttctgcaatgttaaatttaccattaatcctgtccactgtatgttttaatttttatttatttatttttttagagacagggtcacgctctgtcacctaggctggagtgcagtctaaaagtctcatttggatcttttaaattttttcttttctatacttaacatgtttaatcttctagcttcttgaacatacaaaatagttataatattcattttaatgtttttgtcctccaattttgtcactaaatcagcatcattctgggccaattccaattcatttcctctccttataggttggactcttctgctgcttttcatgcctgataatttttgattggatgcagacactgtgaattttaccttattgggtactagatatatttgtattcctaaaaatattcttgagttttgtttcaagatactgttaaaattattaggaaacattcctatccctttggatcttgcttttaagctttgttaggcagaaacaaagcagtgtttaatataaggttcattttttccccactactgaggcaagaccctttttaatactctgatgcttccaatattatgagattttccattcggactgttgaaaatagatgctattcctgcccctgtgcatactttggagttcactggagggtctggacatgttgtttctcttcctatgcagctctttcctctacggtactttactttgcaaacacaagctatcttggccttcccagagtctcagctccattttctcaactcggcatctgccaagccctacctgggggttctccttgtgcttcagctgggaaactttctccagtttacctctgagttcaacctgataactccaattctatttccatactttaaggttcatcctagcattctcctttttcatattcacagttctttttattaagctttattgaggtataattaacatgcagaattgcacatatttaatgtacacattttgatgagtttggacatatgcctaagagtgtatactcaaaatacttagctgggttcagtctattttccccctgaccacttcagtgtggttatatgatttatttgaaagacagctttttcttgtttgcttgttttccattttaggattttttttaactcatacttttttcccttttagagtatatgaaacatcaacatggttcaaaaagtcaaaagtcagaactatatagagttaattttgtatagactaagatatgaatctaattttatctctttctaaatggcaatctacctgttacaaaaccattgtttaaaaagtttgtgttaggtgggcacagtggctcatgtctgtaatcccagcactttgggaggccgaggcgcgtggatcacttgaggtcaggagttcgagaacagcctgcccaacatggtgaaaccccatctctactaaaaatacaaaaattagccaagtgtggtggcgcatgcctgtaatcccagctactcgggaggctgaggcaggagaattgcttgaacccgggaggcggaggttgcagtgagccgagattgtgccactgccctccagcctgggcgacagagtgagggaaaataataattaaaaaaaagcttatcttcatgtcagcaattttacatgccaccttttaccatatatgaaagctccctattcacttggatctctttctttttattctgtctgtccatttagttaccatcacataaattatggtggctttattgtatgttttattatccatagggctagtctccattgtagcttttcttttctcagtgtttccctgactattctttttgttttgttttgttttgagacggagtctcgcccagttgtccaggctggagtgcagtggtgcgatcttggctcacagcagcctctgcctcccgggatcaagctgttctcctgtctcagactcctgagtagcagggattacaggcacgtgccatcacacctggctaatttttgtatttttagtggagacagggtttcaccatgttgcccaagctggtctcgaactcccaacctcccaaagtgctgggattacaggtgtgagcccaggcttgagccaccacgcccatccaagaccctgactattcttacatgtttggtttttcatgtgaaccttactatcaacttgtctagctccagataaaaactttttgatatttctattgagattgtgttaaatttataaattaatctgtgatgttgcatcatcctatccaagagcactggctgtctttccacttgctgtagtctacttttgtgtctttcgggagtgttgtttttctcatataggttttgtatatgtcatactgaaatttattcttaagcatttaacttcttttttgctttgttaatgttttttttctattacatcctctgttttttgcttgtatatttgaaggctactatttctgtatgtaaatttttatcttcctgaattcttttgttctttgagttaattatacctttatttctctagagctttccagataagtatcacactccatctgcaaatacttttacttatttcccaattcctaaacctctaattgattccttaaatataactgcattgcctaatatcttctttagaacattaaatagtagtggaaatagtagatgatcttgttttgtttctgatccttatggaaattcctgtagcatttcttcattaagaaagattctgtattcaggaaaaatcataagtgctatcagaaatattctttttttgtactgtctttatcaggtttaggtatatatattacacttgcttcagaagaattgtttggagttttctttcactgtctaggctgtgacagaaatgtaagtagcagtgagacaatcagttctttgacaattcctctatgaaatcaactaggcctttttgtgtttctcctctgggaatttatctgtttatgctttctttctgtaatggggtcaattttggtacagtttcctaagaaattattcattttttatggtttgcaaatttatttacacagagatctctctgccagatagtctgtcatattttaaatctcttgtatttcaatagttatctcccccttgtcatttcatattttgtatatttgtgctatttcttttttcccttggttatgttagccagtggtgtgtcaattttgttatttttccttgaaacactgatttttatttagttattttttttctattcccaaccttactactttttcttttatgtttattatttccttccttatgtttcattttggtcattttgttgtgcttatcttagcatttggagtttggaatttaatgagtatattttttgtctttcattattattgatataaatgcttaaggctgtgaattttccactgatctttgctttaaatatatcccatagatgctaagtagtatttttatttatttttttttttaaaagttctttaattttagcactcacccattttacttcctttcaatttggtatcatggtgtagctattctaaaatgatcctgctccctaatgccctcagaataaagccccaaacctgcagcccttcatggtttgcttatttctccagccatgttctctctctgtcatatgctcactctgcctacagtttcctttttccttataccacctggccaatgtctagtcatttttgaagatgaagatcaaatttaggaatccttctctgataattctcaacccccaataccatcccagttaagcattcctcctggaaacttaataaaatcatatacttcctttttgtaatacttataacattatattttaatattttgtttttccactaacattgtaagatccttgaaagaaggtatgcttttttattactgttcccatggtgttcagtaaatatttgtttagtgtcccttcagctgtagatttcaaaactactattttaatgcatacattctgacctgtgagctctagcatactctagagcttctttgtcataaacttagtttggttggttggtcttagcttttcaattgaagtgtaacatacagaaaagtacacaaattacaagtgtccagctcaatcaattttcacaaaatgaaaacacctatgcaaccacaacccagatcagctccatgaatttttacaaggtgaacgcctgtgaaactgtactacatatcaagaaatagaaccttaccagccctccagaagcctcctttgtgactcctctcaattgttatgcccttgtttttttcccaaaggtaaccattatcctaatctctaacaacacagattaattttgtctgtttttgaattttatataaatgggaaaatacggtaagtacaactttgtgtatggcttctttcactctgttatggtagttcttttttattgctgtgtaatatttcattgttggaaattaccacaatttacttatatgttctattgttaggcatttgggttgtttccaatttggggctcttatgaataaagctgctatgaaaataatccttacataagcctctttttgcccatgtgaatgcatatcttttcagtatgtacacagaagtggaattgctgggttatcactttagtagaatagtttccaaattcacatccttgccaacagtgtatgaaggttttcacagcttaacagcttcactgacaattagtattttctgactttttcattttttgcagttctggtgagtgtgcagtagtatcttattgtggttttaatttggatttccccagtgactaattaggttgaacaccttttcaaatgtttataggctttttggatatcccctcatgtataagtcatattcatttttctttaactttcttagtacttcaaaagaattccagtatgttctggatacaagctgtcagctatacctattccaagtatctactctctcaccctgacctggttttcactatcttaatggtatcatttgatgagcctaagttgtttatttaatataatagtccaaattatctttttatcttttcgatctagtgctttttagtgtcctacactatttaagacatctttccctatctggaagagatgctttattatttcaccattcgtgcttaaatctacaatctacttagtgttaactttaggatatgatgtgggatgtgagttgacattccctttttcccacgtgtgtatccaattgacctggcaccatttattgctgccttgccactttgccttaaatcagtcgtccctatatatatgattatgtttctggactctaggcgaattctgttttgtctatgtgtctatccttgtgtcagtaacacacttagttgctgtagctttataataagtcttgatgatatgcggtaacattagttctcccctttgttgttattcttcaagactgtcttggctattcttcgccctttgtagccccatataaattttaaaatcggtttgttgatttccacaagaaaacttgctgaaacatgtcagctgaaatttgactgggatagaattgaatccattcatcaatttgatgtatccctccatttatttagattttaatttctctatcttttgtatttttctgtgaaacatctgaaaagattgcacacatctttcatttaaattattcttgggaatttggtgttttatgttattgtaattggtatcttttcataattttccagttggtaccggttatttagatagcaaattgatatatgtatattggctttatatccagcagccttatggatataaatgtacttattaatcctaatgatttatctgcagattttatttccttgggattttctatgtaaacagtcatgtcttccataaacaagggcaatttaatttcaccctttccaatctttacacctttttatttctctttcatgccttattatactgtctcagtcttccagtaaaatttatgaataaaatgtaaaagagaatgctttaaaatttcccaattatctctggtgtttaatttagcttttctgtagttagcctctatcatattaaggaagttcccttgtatttctagtattctaagcctcttttttatgattgaatgttgaattttatcaaatgctccttctgcatttattaagataatcatatgattatttgccttaatgtggtaagtcgcatgaactgatttctgaatcttaacccagctttgcattccttagtcactgtatattatctctttagtgtattcactaggctaatctttttaggaattatatatctttttcataaataagattgatccataattttcttttctttaaacacctttgctagattttgatatcatggttttgctggctgcatagtacaaagtagaaaatgttcccatatctcgattttctgaaatggtttgtgtaagtttgggttttttctttaaatgtttgatagaatgtaacagattagcaatgtcagtgtggagttttctttgtgtaaagttttaaattataggttcagtttctttaaaatatgtaggattattctgattttctgtatcgttttagttttggcaagttgtgcttttctaggaatttatcctagaactttagtttacattgttcacaatatcttcttattattcttttaaagtttgtaggatccgaagtgatttctcttttttcattccttacattagtaatttttgtgttctctgtttttaccttgatcagtcttggtgggggtttattaatgatatcagtcttttcaaaagagccataaatgtccctttaagcactgctttgggtacatccataatttttatttactatccttcagttcaaagtatttcccttgtgatattattacccttgtgatttactttgatgtaggtgttatttagaaatatttcataagatgaaatcaacacatgctgcccctatatctcactgaactcaactatatactctggaaagaatgccaagcctagctatttgtgaactctggaatgtaaataacaggcagattggagaagggccccaaaactcaaaataccacagaagtggggatataaacaagatccaaagtctcataacttaatatccaaaataaccaggacataaaccaaagttatttaacatattaagaaccacagaaatctcatcttgtatgggagaagataatcaacagatacaaaaggcaagatgacacttatgttggaaatatctgacaagactttaaaagctgccattatgaaaatgctcaagctatcagtcacaaaaatgttgcaacaaatatttaaaaagaaaaagtatcatataagaaatagaagataaaaagaagcaaatgtaaattttacaactgaaaaatataacaaccaaaaattttaaactctagattaaaagtgagaatgcagtggaaatgccagaggaaagagtcagtaaacttgaagatagattaatagaattatccaagctggataacagacagaaaagactgggaaaaaagggacagagtttcagagaactgtagaaaaaccacaaaaggtagcaaaggatagacatataaatcagtggaatagaattgtgagtccataagtcaacctgtacatttctggtcaattgatcttcaacaactgtgccatgataattcaacagggaaataagaggcaattcaacaaatggtgctgggacagctggatatccacatgcaaaaagaataatgctggaccactatcttcacccaatatacaaaaattaaaatggatcaaagatctaaatagaagagctaaaacaatacaactttagaagaaaacataggggtacatcttcatgaccttcaatttggcactaatttcttaaatatgacatcaaatgcacaagggagaaaggaaaaacagataaattggatttgataaaaattaaaaacttttgtgcatcacagcacattatcaagaaggtgaaaataacctacagaatcagaaaaaatagtggcaaattacaaaaagcagtctccccttatctttggggaatatgttccaagaaccccagtggaggcctgaaaccacagatagtactgacccctattacaccatgttttcttatacacgcacacctgtgataaagtttagtttataaattaggcacagtatgagattaacaacaacaatagtaaaatagaacaattataacaatatattgttcacaatttcaaagatagaagatttgttcttactataggccttagcagcattagcatatgatatgttctcgttttttaaaattaagttggatacttttcatcatttcacttaaatgaagcactttagggcttctctttggcatagcagaactgccaacattgctgctcctatgttctggggccattattaagtaaaataagggttatttgaacattagaactgcaataccgtgacagtcaatctgatggttaccaagtgactaatgggcaggtatcatatacagtatggatcagatggacaaagggttgattcatatcctgggcaggttagagcaggatggcgtaagatttcatcatgctactcagaaaggtctgcaacttaaagcttatgaattgtttatttctagaatttttcatctaacatttttggaccgtggttgaccacaggtaactgaaaccatggaaagtaaaaccaaggataagagaggactacatatttgataatggtatagcatccagaataggtaaagaattcttacaactcaaaaataaaaggacatacacttcaatttaaaaataagcattcaacacaggactggaattcctagccaaaacaattaagcaagaacaagaaataaaaggcatccacattggaaaggaagatgtaagtttatctctctgttcacacatgaaatatatgtggaaacctcacaaaactgttagaactaataagcaaaaagaaagttgcaggatacaaaaatcaacaaaccaaaatctattttatttccgtatactaacaatgaataatcagaaaaggaaatttagaaaatctcatttacaataatatcaaaaagaataaaataattaggcataaacttaaccaaggaggtgaaagacttatatattcaaaactacaaaatgttgctggaagaagttacagacacaaataaatggaaagacatctcatgttcatggattggataaattaatattgttaagatatcatactactcaaagtgatctgtagatttaatgcaatcactgtaaacatcccaatggcttgcttgctttttttttttttttttttttttttttgatggagtctcactctgtcacccaggctggccattttaagttgatacggaatctcgggggaccttgaatagccaaaacaagttcgaaaaagaaccaatttgggcaattcacactgcctggtttcaaaagtaactacaaagctacagtcatcaaaacagtgtggtatcaatgaaacagaatggtcagcccagatttaaacccttgcatatggtcaagcaaacttcaacaaggataccaacaccactaaatgggaaaaagacagtctctttaataaatgatactgggaaaactgaatattcacatgcaaaagaaagaagctggacccttatcttacaccgtatataaaacttaaatgaattaaagaccaaaatataagaccccgaactacaaaactagcagaaaacatagggaaaaagcttcatgacattggatttgacaataatttcttgaatatgacaccaaaagcacagctaacaaaagcaaaatagacaaatgagactacatccagctttaaaacttatgtgcacgaaaggaagcaatgaactgagtgaaaaggcaacctatggaatgggagaaaatatttgcaaatcatatatttaataaggggtcaatatccagaatatataaagaactcctacactcaacaacaaaaaaatctgattttaaaatgggcaaaggacttaaagtgatatttctcttggtcaacaagcatatgaaagagtgttcaatatcactaattgtcagagaaatgcaaatcaaaaccacaatgagataccacctcacacccattatgacagctactatctaacaaaatcagaaaataacaagtgttggtgggaatatggaggagttggagcccttgtacattattgttgagattgtagagtggtgcaataagcctgtagtttctttaaaaacctaaaaatagatctactatatgatctaccagtctcacttcttgggtgtatatccaaaagaattaaaagcaagatctcaaataggtatttacatacctatgttcacagcattattcacaatagtctagaagtaaaagcatcccacatgtccattgatggataaatggaccaacaaaatgcaacgtaacatataatggaatactatacaaccttaaaaataaaggaaaacctgttacaacctacagcatgaaagaaccctgagaatattatgctaagtgaaataagctattcacaaaaggacagatgcagcatttttctatttatataaggtatctaatgatcatagatatacaaagtagaatggtggtcaccaggggccgggagaagggagaaaggggagtttcagttctgcaaggtgagaatgttttgaagatctgtttcataacaatgttaatatacttacattactgaactgtacacttaaaatggttgatagtaaattttatttttttaaccacaattaaaaaaaaaaacccaaatggacattgtaaaagtggaaaatacctaaaattaagaaatcaccagagggactagcaggagactcaggtatagcagaagggatcagtgacaaagacaggttgataaaatataccctaaatgaagcaaagagttaaaaaaaaaaagagaatgaaatagaagaatggcatgtgacagaactgtgaggcagtgtgaaccattttaatttacatgtaattggagcaccagaagtagacaaagaatgcctaaagagataatggctaagaattctctaaaaactgattcatacccatagatgcatgaatctcagccaatcacaagcaatatgaacataagcaaactaaaataggcacattatagcagctaaaggaataaaagatatattacaaatagtggagaaatacaatgataagaacgatggctgacttctcatcagaaccctgggaggctggaagatgatggggtgacatctttaatgtgcatgaagaaaaaagctatcaaccccagaattttatattaagacaaaccagacatttttatggaaaaaagcaggcagaattaatctggagaattcactacaagaaatattaaaagttcttcagactgaaaatatatgattttagatggaagcacaccctgactacttgggtgtggggaggggagggcttgtaatgccccaccatttgtgttccatctaggttgtggtatggggactagacatgttctgctgggatggggaagctagatcttaagctgccttaccaccatgtgccagtggggcctcacagtgccaggggccttcaacctgaattctccactgaacctgctggtaggtagagtttaggtgtatttggggtgagaagtgggtagaggtagattggttgggccttagtaacaaacatttctgtttctcccactctagcatgagcatgtgaatatttgtgaatttcttacctatttccccccaggggagaaaatgggaagtgagggccactggtaaacactgagttagaacaagtgagtaatcccacctacataatgaatgtgatggagtcattgaagagtctgtagttcctcttctccagacttttgtgattaatttgttcaacctcactggcaacttcttgactgaagacagtattaattagctatttcccctgactggggagcagacgtaaggaccttgagctctcaaggcttctcttaaatttacagaagtggtcttagattctctatggaactagggaatactggctctgcagacgggcttttagtttgctctccagacgaacccagtttgaactctatccactttgaagttgcatcactaaatgaattacagcaatgcttaatctttaaagtatgccatatcccaaacttccaattaaaactgtagagaacttctgattataacaactcagggtttaaaaactgacctgaactgattgcctcacaggtatgagagaatcgaaatcccaatccatattgtacctcatgtcactatcgggaaagtgtgccttgaatcagcagtagagctgcccaagatcctgtgccaggaggagcaggatgcgtataggaggatccacaggtagagaccctcttcactcctcttctctacttctcaggacctagtctctcttttcttcttctgtccttttctctttagcagctcaactcttgaggccccttctttttgcctctctgggaagctttctagcagtctccaatcataatgtttctcacgttgtatgataatttcttcaacatttgtttttctcctgctactttggatctttcaagggcaaggatgctttcttttttggttgagaaaagaggataatccacaacatcttaatcctgttgccaagcactaggtcttgcccaataaatttgtactaagtcagagctttggtgagagacagcaatttcaaaattatcactttgaattatctttgaataaaatcacatcccccaaatcatcaagaagttgatattggggatttaaatactacatattcatctaatacagttggcaacggtatagtccatgaccattttgctttcccttcagtgctgctttgccactaacctaaactattttattctttagccttacacatctggactcagtaaccaagatccataatggctcaggtaagaattgtttcttgagtactcagcattttttctgactatttccctgaaacactcagctgacagatgcaaatttagtttaagtgagtgaagtgatgggtacaagttgtcttcaggcttcctttcccaagggttttcctgatcctgagcccaacatttcttgtaaactctggggatccatgaatactataaatacagcctagagtaagacaggaggaaagacaggaaagagctttatgatagacctactcagtgatatactggcacacatttaacaaccagatctcaaggagcagggaggaccctgatttgtcgtgtttgacggtttccatggtgtaatgcccctggcatggctggtttcaagcaactaacatgtcatcaactagcttataaacttcttggaattttaatagttggcttttgtgagctggcatgaattggttccagcataacactaccagcctgtcgtggtgggaactgaaagagatggatggatacacagatagagagataaaagggaaggcatgagggagaaaatcttttgatgtcaataaatataaaagtaatttttgtacaaggcaaaggaacaaaaagctgaatacaatatatatactaattcacttgtccctaacatacacattgccccagccacactttctgtctgagtaaccctgacttctgggtcattctgtgcactcttccccagttacttccaaagtcaccagtgaggaagaaggggaggcttttgagtgttataggcggttacttttcaaagaaaagggagaaatggcttggtctatctgtcccataatttcggtctcaggataaaacatgacagagttaaaagttggtaatatatgatatataaccatattctaaagccacagtaatttaaaaagtataaataatagctcaaaataaacaaatagatcagtggaactgaacagagtccagagataggcctatgtatatataagaatttatatttagcaaagatattactttaaataaatgaaaaaagcatgaattatttactaaataggattgggacagttcatttctttctttgttcattcaggaaacatttgagtgctattccaggcactaaggtacagtgctgaacaaaagagacagttttaaccttcatggagttaacattcttttatttccatttgggggaaaatagattcctacctaataccctacacaaaaaataaattccagatatatttaaacttttactattgtggtacaaccactttagaaaagaggttggcaattatacttgccaaatgtcataccagttcctttcctaggtatatacgtcaaagaattgaaaacagctgctcaaacaaaaacttgtacacaaatgtttacagcagcattattcacaatagccaaaaggtagaaacaacacaaatgtgtatcagtgggtgaatggataaactctgatatatccatataatggagtacaactcaacaataaaaagaacaaactactgaaacatgaacaaaaaggacgcgtctcaagaacattatgccaggtgaaggaagcatcacacaaaaggctacatactccatggttccaaattcaagaataagcaaaactaatctatggtgtggtagctgcctgggcccaggggtgaaggggcatttgatgcaaagggaactgcggagggtattgtttgagggtggtggaaatggtatgtatcttgactagcactggttacataggatgtcttagttcattttgtgttgttatgaaggaatacctgaggctgggtaatttataaagaaaagaggcttacttggctttacagttttgcagactgaacaagaagcatggtgctggcacctgcatttggtgagggcttcaggctgcttccacttgtgacagaaggcaaaggggagcttgtgtatgcagacatcatgtggcaacagaggaaacgagaatggtggagggaccaggctctttttaacagccagttcttgtgggaactaacagaggaagaactcaccccatgacccaaacacctcacatgaggccctacctccaacattgggggtcacattttaacatgaggtttggagggccaaatatccaaattataacatggggtatacatttgtcaaaactcatagaactgtatactttaaattggttcattttactgtctgtaaattacacccccaaaagctcattttataagttaaagaaatacaggaggaaaaatataagaatttttttcagactctaggaaggtgatagcctaagaataatgtgaaaccctgaattcacaaaaggaaagattgactaaataaaaattaaagacttttatggccccctacaaaaataaaaatgttaattattatctttaaaagaagtatagattaagataagattatcagcttttcaccttttcaaagattaaattgagagacaattaggtgaggatgtgagggaagtgaacagtctcactgtttctggagatataatttggtacaatctggaaaatactggataattagttttaaagtgtacatgtacttagattttaaagtctttaaaatagcaaaaaactggacagtggtcatttaagtaacagtcacatattatgagagagaaaaagatacttacattagatggaatttgttttaaaagagtaccttagaatctttgtctcaccatgaagctgaacagtcacagtaaagcataaaagatggtaactcccttactcttcatccctctgttcttcatttcaaaagaggagctctcaggtgtattcaattaatgtatatttctgcaatatacataacagtttatatacctacagggcgctctggaaacgtaagttgcagaaggcagacttctggcccattaggaggttatggtggtttacagcaagggaaggtctgagaggctggggaaaggaaccctttcgtggctcttagcccttttgcctaagggagtaaagagctggccctctttctgccaggcttccctctggcttatggattcaagatggcctcagaatgggtattttctatgctcagctcttctgtttttcccctggctgggcacagaaaatagtttaccagtcctacttattacactttttctacttccttctccaaccccttctttctgtgctcatggttgggggtctgttggtgatagagtggaaacatgctagtggatggtgcttttccacaattattctcatctttatttttcctattgaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggtaaaaaacttctttttcaatttgtgtactaaacacagtctgaaaatgcacacagctcacatgcaggcagacaatagagtagttatttttcacatgcaatcagcacaggatgtcttcctgacagtttaattagagttcactgaaccctcctacctataactgaccaataaggagcttatgcaagatgatttaagtagaatatgaaagttatttttaaaaaggctatgagtggtacaatggcaaggaatatcttagaataaaatgtctggggggtatattttaaacatttatatttccctttcttttaacttggaagtctttattttcattttcaaatacattcactcactagaatattttatgtttcaattttgtaggtatgatgcttatgttggacaagcaaataataaatctagtgtgagtggaaggaagtaccccacctctatgccctcactgagagggcagtgtcttccttcttgatttctaaaatatatgttctgagatacctatcaaacgttgaatctctgagggtgccctttttagcccaacatgagttctagcatatttgactctgaagtaaactcctattgagcagatcctatctgcctaggagtttccattatagtaaaatgtgtttctccagaaacatttaggattgaggatataataaaaatcatgctttaaaaagtttggttgcattactcttatcatgtaaaagcacaaatgataaatgtgtctgcagaaaagacatacttttctgtgtgcttgttgcatactggaaacaaagtatgcttgttggatactagaagttaagtgataaaggctgtttttggtttttgtttctccctctcatttttcacatttcaaagtgttgtccagaaccacctgcatcagaatcacttgaaggtcatactctatctctggggataaaatctgcatgaactacttagctgatttgaaaaccactagccttgagcatatggaatgtatatactatattgtccctaatttcccacagccactgttcttctctattctttttctttccctataggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatctggtgatactgaataaagtctgtggtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaataaaacgattggaatatttttacatgccaacctttagcacaagtccttttccctttctgggtttcattttctttaggtatagaatgagattagagtagttgaccaccaaggtttcttttagctcagtgtccagtctttaaaagtgttgagcatcacaagaaacagtggtgtgaacaggatgtatcattattttcccagctgcaccaatctggcttacctttacacaaccctgtatccccttatgaacactagattctctattctcaatcacatccaagactctcatggtaactgtatatacttgttctctctgttttcttatctcctataatttcaactcattgccttgtgacctctgtccacagcacttcattgaaactactcctgccaaagtcaccaatgagctccatacagtgaaagtcaatagttgcttttcccatccttgatgaacctctcagtattgacacagttggtcactcctccttgaaatctacttccttggtttctcttattttcttctctggctatccttcctgctatccttttcttctctagctgttccttctcaaattcattcatagacttctctatctttgcatacctatatgcagttgacacacaaatctgtatctgtccacgcctctatctgaactccagacctacatttccacctctctactggacattttttttgagacagggtctcactctgttgcccaggctggggcgcagtggcatgatcatggctcactgaagcctcgacctcctgacctcagcctcccaagtagctgggactacaggcacgcaccaccatgcctggctcatttttttgtattttttttgaagaggcagggttccaccatgttgcccaggctggtggcaaactactgggctcaagcaatccacctgcctcggcctcccaaagtgctaggattacaggcacgagccaccgtgcctggcctccacttggctgtcttaatggcacataaaaattaatatatctaaatctgaaatcatggttttcaatctaaactatattcccttccaacatttcttacctcagtgaatagtgaatgtaacatccatttgcacaaaccagaaaccaaatagacattcttaacatctctctccatcaccttctaaactatttatattgataaagttacagcgatttgaaattctttttctagcctagtaatctgagtaatttgtaggataaacatgttgggggaggggcaggtacatggaggtgtcaaagtgcctgatggctgaggaagcaggctgggattactgcatggaggtgtcagagtttccagctttgtggctccatggttgggtggaggggcagggggagagatccagtggaagccatgttgtgccagtgccctcagggcgaggaggcagccagcagtgtgctacattaagcaaataactaagttgattgagtgaagaagtaaatctgttgaggaaaatgggagctaggtttctcaatgtcagagaaattatttgaaaacatggaaaggccaggcgcagtggctcacgcctgtaatcccagcactttgggaggccgagacgggtcaggagattgagaccatcctggctaacacgctgaaaccccatctctactaaaaatacaaaaaaaaaaaaaaaggttagctgggcatggtggcaggcgcctgtagtcccagctactcgggaggctgacgcaggagaatggtgtgaacccgggaggcagagcttgcagtgagcgaagattgcgccactgcactccagcctggacggcagagcaagactctgtctcaaaaaaaaaaacaaaacaaaatcatggaaaggaggaagggtaaaatgaatctcatggtattggattaaaattggaaaagagttcattaatatgaactcttgttcaaaggaaatatatatatatatatatatacacacacacacacacacacacacatatatacacacacacacacatacacacacatatatacacacacacacacatatatacacacacacacagaaaccctatatatatatatctcagagctgagaaaggtatgtgtatatgtacatatctgtctcagctccgtccaccaagagggactagaagtgacacccagtggttatgagcacagctagcaccaagatgctgatttccaaaccctccactaaaaatggaattgaattgacagtccagaaataagcccacacatctacagtcaactgattttcaacaagggtgccaagactatgggagagaatagtcttcaacaactggcgaatggacaagtggatatccacgtgcaaaataatgaagttggactgagatcccacacgataaatgaatattaactccaaacgtattgaagacttaaattcaagagcttaaacaataaaaactttataagaaaacagtagtaaatctttacgatcttggtttttacaatggattcttagatatgacaccaaagtacaagcaacaaataaaaaatagataaattggaatttatggaagttagaaaattttgtgcatccaaagacatgatcaaaaagtgaaaactcaggacaatggcagaaaatatttgcaaatcctatgtataagagtctagtatgcaaaatatataaagaacactgaaaacaacaaaaaccaaacagcacaattcaaaaatgggcaaaggacctaaatagaaattttccaaagaagacctacaaattgcgaagaagcacatgaaaagatgcttgacgttactagtcaccagagaaataaaaatcatgagatatgactttatactaaccagaataaaaatgtaagagaataacaagtgttggtgaggctgtggagaaattggaactcttgtacactacaggtaggaatataaaatggtgtagacaatttggaaaactggctgatggctcctccaaaacttaaacacagaattaccataagacctagcaagggcatttctaggtgtatatcccacagaactgaagacagaaatttaaacaaaaactagacaacccaaatgtctatcaaccaatgaatgggtaaacaaaatgcagtctgttcttcaatggaatattatttggccataaaaaggaatgaggggtaggagggagcagggatagagggttgatggctaagagggatgaggtttctttttgaggtgatgaaaatattctaagttgactgcagtgatggttgtacagctctatgactatactaaaagtcattaaattgttcactttaaatgggtgaattgtgtataaattatgtctccataaagctgtttatttttttaaaagacacacaaaagaagaaactttcctgcagctccagctgaccttgcaggctggcctcttccgctctgacctgtgctccctaagctccctgcgaaggagataaaatgagctcctggtctgcaacagctattggttattgtaatgtctgcttttgtttaaaaagaaaaaaagacccaactccttatacagtttgaattgtatatatttggggatctctgagtttcctgtatctggatgtctaaatctcttactagacttaggaagttttcagcaagatgactggatgatcatgtttcagcctctgtgagacaaacattacagcagcagatggcacaagacccaggagcctgaggatgaacatcactggaatccacacactcatcagatctgtgcttcccaggcagcaggcaccagttccccctttgccttccaccatgattgtaagcctcctgaggccttcatcagatgcagatgctgatgccatgttttctgtacagcctgcagaactgtgagccatttaaacctctttataaattacccaccctcaggtattcctttatagcaatgcaaaaatggactaatacacaatttaggagcaaggtgtaggtaagacaaggaaaggactggaaaagggtgaagtgactgctgtaaggactggtaacatcaatcacatggctgtgaaaggagggcaacagtcctgactggtggagagagcacactttaaactctgtgaaggcagaggaggggccgctaacatctcagctacttgtctgcagagcctctggacaatttagcccagactgccaccaccactttcaactcaatggctggccaacaaatcttaatctaaggactctcagaaacttcccaggaactgctgactcaagtagttaacagcctccattcagaacgatagaatgagattaactttctggaaactaacaaaactcttttgtacaagagcttaatagaattggaccctgatcccaactcaacacaatggcactgctgaggtcactacaacttcttacatgaaaagaagctacctatactagcttgccacacacaaagtggtctattgtctctaatgtacatggtaatgggacaataacacattacccaggacttcctgctggtcagtcaaggcaggatatgtgcaactgtcagcatcccttactgcacctgggttaatgaaatatttaactggcttggctccagttggggagcctagctgcagtgtgtatcctccaagtgggcctaattagagactcattcttgtatatgttgcccaaaacaatcagaatgtatttggttaaggcccctataagcacagttaattagagtaatttgatggggtggcctatgctcctgagaattcttagctagctatttgaaaagtgagggatggagctgtagagagtggatctgccatggtgcccttgtgacctggcatgcatatatctatgcaagctaggcttgaattgcaacttatctgagtcttggcaggatgtatcatgatcctcccagaacacaagaggatgggagggtggtgaggtgctgtttcaaggctatctctaacctcctaatctctcctgggaggctgccactgagacagacagtttctcatctgagtactattgaggtctgaggctatctgctctgccccactcagggtatagctacagaatataaaactgctagctgcagtctaaaaggggctcctcagcaagggagtgtcccataactggtgcagcaaacatgcaggccttgtttcagaagtcctgtttggtgcagggaacaaggacatggggagctggcacctttggcccatcttcctcttgctgtctatgtaggtaataaactgaatcttaaaaggacatgtcattactttagaagccaaatcaatcactcttgggcttggcctttttttgacaatgtggtagttatgtacaagagtgtctttgtttttgagaattgtacactggagtgtttaggactgatggaacatgtctgcaacttggtctcaaatggttaagaaaaagccatatgataatggtggtacacacatgcacgcatgcatgctgcagaaatgtgaagtgttaccaattgaacaatctggatgaagtgaacatgggagttctttgtactattcctccaactttttggtaagtttataacaagttactttttaaaatctactgagcttaaggccagggggaagtcttatttttcactttgaactcttctgtaaattgtgttttgaatttctacaatgagtatgtattactttcttaatacaaaattaaagtgtccgatttttaaaatcacaaaagtaatataataaaggaaacttgaaaaatgtgaagagaaacctataatttcctcaaaataactcatttttggtagtccttttggtcttctctttcttatttctgttattcatttctagtattaatgcatcttatagttttgcatgtggatttcttcatttaacataattctaaaactttaatatgttgtataggttttataattttagtgcctgtagtcccagctacatgattcactaaacaacaacagcaaaccctggggagagggacatctgatttccagagccaccacattataacatcaaaatgtccagttttaaacaaaaaagtatgaggcatgcaaggaaacaaagtacggcccactgacaggaaaaaaaagtttataaaaactgtcccagacaaagcccaggtcttggacttactagacaatttaaatcaacagttgtaaatatgctcaaagaacaaaaggaaaccatgaataaacaattaaatcaggaaaatgatatctcgccaaatagagataacaaagataaaatttttaaaaggaacaaaatagaaattcaggagctaaaaactataataactgaaatgaataattcatgagagagacttaacagcagatttgagcaggcagaagaaagaatcagtaaacttgaagataggtcaattatcagagacccaagtatcaaaaagaaaaaagaatgaagaaaaacaaacagatcctcagagacctgtgggacaccatcaagcttaacaatgcacccacaatgggagttctagctaaagaaagaaggggcataaagaagtaatggccaaaaactccccagatttgatgaaatctatgaatctacatattcaagaaactctaagtattttgagagggataaacccacacctagacacttcatagtcaaaatgtctaaagccaatgacagaatcttggaagcagcaagagaaatgacttatcacatacaactgaacgtcaataatattgacagccaaattgttgtcagaaatcatagaggccagaaggcagtgggatgacatattcaaagtgctgaaagaaaaagtgtcagtgaagaattatatgtccagcaaaattatcctacaaaaatgaagtaaaataatgacatccccttaccagtggatctgttggattgaattaaaaaaaagaaaaaataatgacattcccagaaagaaaaacaagagactgccattgcagacctatcttagaagaaatactagagagagttattcaggctgaaatgaaaggacagtagactgtaactcagattcacataaagaaataaatatcattggtaaaggtaactacatagataaatataagacatggtatgttgtatttttgtgacgcttttttcttctacttaatttagaagacagctgcataaagcaataattctaggatgtgttgatcggcatataatgtaaaaaatatataatatgtatgacaataatagcccaaaagagaggagaatagagccatgttggagcaaatttttttaatatggttgaaattaaattggtatttattaaaaccagatgattttaagttaagatgttaattgtaatcaccagggcaaccactaaggaaataatttaaaaatatagtaaagaaacaagaattaagatggcatactagaaaatatgtaacacaaaagaaggcagtaatggagaaatagaagatcaaaagacacaggtatatagaaaacaaagagcaaaatgacaggcataaatcatcgcttatcagtaattagatataaatgaatgagtgagattattagaatacacacaaaaaaatcctattatatgctgttcacaggatacagactttaaattcaaagatacaaataaagttaagatgatgggaaaagatatatcatgcaaacagcaaccataacagctggaacagctaaactaatatcagacaaaatagattttttaaaatgttagagacaaataggggcattttataaagttacaatggtcaatccaccaggaagatgatataagcatataggcacataacaacagagcctaagatacatgaagcaaaacctgacagcatcaaagcagaaatagaaaattcaacaatgactgttggagacttcaatacaccactttcaatagtggatagaacaactaggtagatgataaacaaggaaatagaagaactgaataacattatcaaccaagaagacctaacagacaacttacttataagacacttaatccaacaatagcagcagaatatacatactcctcaactaaacatgaagaattatctaagttagatcatatgttaggccacaaaacgagtttcaataaatttaaaggactgaaattatacaatgtatgttctctctccacaatggaataaaattagaaatcaataacagaagaaaatttgggaaattcaccaagttatggaaattaaacaataaattcctaaatacccattgggtcaaagaagaaatcataagggaaaatagaaaatactttgagataaatgaaaaaaaaaaaccaaaacttatgcaatgaaagcagcgcttgggggaaatttatatctataaatgcctacagtaaaaaagagaaaggatttcaaattaataacccaacttctcagcttaaggaactgaaaaaaagcaaattaattccaaagctagcagagggaaggatataataaaggttagggtggtaacaaatgacagggaacaggaaaacaatagagaaaaatcaataaaaccaaaagttggtttgctgaaaagatcaacaaaactgacaatcctatagctagactgactatgaataaaagattcaaatttctaaaattgggaatgaaataggagacaatactacaaaccttacaaaaagaaaacgggaattatatccaaaggggcaaagcaagatggtagaatagaagcctatgccattcatcctccctccccacacagaaacacgaaattttaacaattatctgcacacacaaaagcatcgtcacaagaaccaaaaatcaggtaagcaatcacagtacctggttttaacttaatatttctgagagtcattgaagaggataggagagacagtcttgactcacagacagcacccctcctccatctcctggtagcgaccatgcatttgcaggtagggagcatatggaccagacctaaccagaggggaattgcccttcccagtggtcagaccttaagtttttgcaggcctcgccaccatgggccaaagtgctctggggttctaggtaaatttggaaggcagtctaggacacaaggactgcaattcccaggtgagtcctagtgctgagctgtggactagggtggcacatgacctagtgagacacatacctaatggagtgcttgcagtacccctccctcaacaccaagcagtgcagctagcatcaaggaaatgtttaaggagagaagagtaaagaggactttgtcttgcatcttggataccagctcagccacagtaggatagagcactgggcagtcatgaggcccccattccaggccctagctcatggacaacatttctagacacaccctgggctaagaaggaacccactgtcttgaagggaagaatccagttttggcaggattcgtcacctgctgactaaagagcccttgagctttgaataaccagcagcaatacctagggaatatactgtgggccttgggctctgagatgtgctgtcttcaagtaagactcagcacattcccagctgtggtggctacaatgagaggctcctgtttgagaaaagcagaggaaaaagtaaagggaactttgtcttgctccttaggtaccagctcagctacaatgtggtagaacaatgaggaggctcttggacagcatttctggacctgctctgggccagaggggagccccctgccctgaagggtgagtcccagacctggcagcattcaccacaagctgaatgaagagccctggagctttaagtgaatgttggaaatggcctggaagagccccccaagggacagggttggtcgtggccacagggagaggcacctctgcctgtggaagggggagggaagagtgggaagtacttcgtcttgtggtttaagtgccagctaaaccacagtagaacagagcatcaggtaaatttctaagatttttttattctaatccctgggttattaccctgataccaaaaccagacaaagatacattaagaaaactataggccagtatctctgatgaatattgatgcaaaaatcctcaataaaatactaacaaactgaattcaacaattcagtttatattacaataaattagataacatagatgaagtagacaaatttttagaaaaacaaaaaccaccaaagctgacctaccaataaacaaaaaatctgaataaacttatgagaagtaaagagattgaattactggttttaaaactttccaccagtaaaagcccaggaccagatggcttcactggtgaattctgccaaacatttgaattcatataccagttcagaattaacagcagttctttacaagctcttcaaaaacagaagaggaaatacttctcaactcattctatgagaacaatactaccctgataccaaaaccagacaaagacatcatatggaaagaaaactagacaccaataattctttatgaatatagatgtaaaattcctcaacaaaatcctaggaaacctaatccagcaacatataaaaagaatgaggccccattaccatgtgacaattttcctaagagtgcatggacagttcaacatacaagaatcaatcgatataatacaccagattaaatgagtaaaggactaaaactgcatgatcatctcaacaggtgcaggataagcatttgacataagccaacacgttttcatgagaaaaagactcaacaaactacaaagaggaaggaacttccccaacctgataaaggccatatatgaataacccacagctaatatcatacttaatggtgaaagactgaattatttctgcataagatcagaatcaagacaaggatgctgtttcctgccactttaatattgtactagagattctagccagggcagttgagggcaggggaagacacccaaattggaaaggagatgtaaaactgtatctatttgcaaatggcttgatattatatagggagaaccctaaagaatgcatgcacacacacacacaaaacctattagagctaataaatgagctcttcaaagctgcagagtttgggcagggttgctagctgctctggtactggaaacccaatttagctgggggttgtcaaaacaaatgggtacggggtttcttttgcaagtggtggaaaggctgtagattgatcttggtgatagttgcacaactctatgaatatactaaaaactactgaattttacacgaaatgagggaaaagttgtagtgtggtgggccccccaccatgttacttaagagtgtatgtccacggcttgaaacttcaaggcttggcggtgagccaaggccatggtgcccagcctaggagcaggtgtccttgagaacccaaacatcctggaatggatctgggaacccactacagcaaacagtctcattgcacacagtaggcaaagagccaggaaattagcttaaaagcagcttagagatgggaggcagggcagatctctggagttgtcctgctgctgcccaggagtgccctgtatgtaagtcctaataaactcctaagatggacttctttggtaccttggctccttcccagtttggggggcccagtttgagggaatgttacagtgccaggcttttctcataacgaagatatatgtgaattaaatatcaataaagccatttaagaaaatatgccttagaaagatgtgatttaaaagtaatgtgtgtgcatgtctaaacaaacttcaacattccttaaaggaatacatgaacatacaacactcaacaaagcaaaatgaacagtatctggcatccaatcagcaattactaggtataggaagaagcagaaaaatgtgacccatacacgagacaaaaataagtcaataggaacaggccaagaaatgcccaagatgatggaattagcaaatatttaaaaataaccattataactattataatatccacaagggtttaaaggagaatgttcattcttttaaaatctttcattactctcattatgttgaataatataaaaagaaccaaatggaacttctagagatgaaacatgcaatattagaaacgcaacatgttctagatgggattaacagcaaatcagactctgcagaagaaaagatccgtgaatttgaaggcataacaaaagaaaatctccaaactgaagcatagggtaggaggaaggctcttaaaaaatggaaatgaacagagctttggtgaactgtgatacgatcatcaagaagtggccagacgtggtggctcacgcctgtaatgccagcactttgggaggcccaggcgggcagatcacttgagcttaggagtttgagactagcctggacaacatggcaaaaccccccatctctacaaaacatacaaaaattagctgggtgtggtggcacatggctgtagtcccagctactcaggaggctgaggtgggaggatggcttgagcccaggaggcagaggttgcagtgaaccgagattgcaccattgcactccagcctggctgggcgacagagcagaaccctctctcactaacaaaacaacaacaacaaaatcactgagtgtaatacacatttaattggaacactccactcaataatagaagaatatacatcttttcaagtttacaaagaacatttatggctgggcgcggtggctcacgtctgtaatgccagcactttgggaggccgaggcgggcggatcacgaggtcaggagatcgagaccatcctggctaacacagtgtaaccctatctctaataaagatacagaaaattagtgaggcatggtggcgggcacctgtagtcccagctactggggaggctgaggcaggagaatggcgtgaacccgggaggcggagcttgcagtgagcggagatcccgccactgcactccagccagggcgacaaagcgagactccgtctcaaaaaacaaaaaaagaacatttaccttgatagaccatattctgtgccataaaataaatctcaaattttaaaagaccaaagtcagaaaaaggtgtttagacaacaaaagcagtatttagcagtaaatgtctatattataaaagaagcaatacatcaagtcggaaacctagccttctaccttaagaaaccagaaaataaagagcaaaataaacccaaagcaagtagaagaaaggaaataataaaaagcataagttcatgaaatagaaacagaaaatagagaaatcccatggaaccaaaagttggttctttgagatcaacacaattaactctttaggcagaccaatcaagagaaaaaaagaacatacattaccaatatgaagagtgagagaagtaacatcggtaaagagtctacagatattagaaggataataaagaaatactatgaacaactctatggacttgtgaatctggtgctgcctgaagagtaggaagacatgacctcaagcaggctgcagccctgataatgtgtgactgaagcttccctaacaatgccatatcaagaatttccaaggtactgtcataggatcacctaacttcccaagacctgaagatctcgagagctttcatatggagtccccaacatgtccccgttcctcataatattcgttaatggttgttgtttattttgttactgtggcatgtactatgcaaagcgccctagctcctccagagatgccctgccccaaacctggacttgccctcagaaaccaagcaagtgcgtggtacctgccttcttgggccgggcagccatctttcccagcattcttgcagagcccgagctcctcgcaagttcaaatcccacctcataatgctggatgtctgcgtcaggctgcatgaagtaaggtcgcccgctgagggctccctgcagggtcaggcatttcttccgtcacctggggctccttgtccaaaaccaggggtgccggtaccctgctcagggtctggaagaggtggggctggactctgtcgccatcaccctcgactcgcacatggggttatctgcgtccaaggctgccctcggggcgaccaccgatgagcccatggagcctgagccgaaactggctggtgagtaggaggccgggtatgggcagcccacgcagctagtgcagtctgagtggggaagaacctcctaatggctgcaccttttctccttccgctcccccctccccctccccctccccctccccctcccctcagtgccctccccttttccacgtccctgcaggagggggagtttgagctgtcatttctagtaatctttgagcagagaggggaacctctggtgggttgtttgtttgtttgttttttgttttttgagacagagtctcgctgtgttgcaggctggagtgcagtggtgcgatctcagctcactgcaacctctgcctccctggttcaagcgattctcctgcctcagcctcctgactagctggcactacagcagcccgccaccacgctcaactaatttggtatttttagtagagacggggtttctccatgttggtcaggctgctctcggaactcctgacctcaggtgatccgcctgcctcagcctcccacagcgacctctggtgtttttaactacaaattccaaaatatttagaaattattcaactaagataggagacaaagagggtggaataataacccaggcttcttagaaaggtctcatttcccaagttcaccccagtgcccttataaattgtaacattcagcgagtcttctgaaggaaagtctattgaatagattctcccttaggtattcctaacctaacgtccatgaataggctttagagtgtccatggcacaatttttgtgccctgtgtatgtttctaggaggaagatttttgattcctagagtgacccgttgctcaaaggatagactcccagtctacccagtctagccccattccctgttgtttgagcttgtagtgagcagtgacttgataaacaatgtgtgctattggcagagtatacttaaattttacagctattgaaagcttcacagctagctcactgttttgatcacccctttatgttggtattttgcttaaactattcattgacttaatctgtatttgccttctgaagttttatcttcttatcatcgtgctaatgtgcatgtgttacagcaagttactaagttaaatagagattaatttcatatatatatatatatatatatatatatatatatatatatgtttgcaaagcatcattctcagcaggccacatactagattctctgtatatattatacagtcctggatacttatgtaatatatgccagaattggcttctgaagacctaaagaaatgctcattaatgaataagtgccatggatgaagttgtgccataatcatagtttgtagacagttttgaaagcaaagaggattttgaactggtaaaaagtagggaatcattgccatgttcttgaatgtgaaaatcaaattatgaaacttaacttttgaggggctgtatgaaatgaattcatgaatggttataggcatgaggccagaaatttaaaagctgtcacaataaactaggtacaaagttatgaggtagtggactcaagaaaaagaagcaataaataaaaggatacgggatgcagataaaaggatcagagatggagtgacagtacaaagaaagttcctaactgaaccttcatggaatgacagttttcttgagagaagtagtgacagtggttaatagcttggtctctagggtcaaacaaatctagtttcaaatcccagccctgccatttaactacctgtatgatcttgggtatgttaccttcttcagtactgttcattcatttaataagtattgaccaaaacctgttatgtgccatctgctttgctgggccttgaggaccaaaatggattcattccctcccctcatcaagtatgcaagataactaaaggcattaaatatcatgtaacatataacagtgcaaattgtaatacatgtaatgaagaaaatgtttttgaggattccctatgtcatttctccaacatttgattgcatctgtacttaagttaaaattaccaattttggttttgaaaattatttctcagtctgtattctaatgcttgtcattgtctctaatttagatctaatacagtacatcagtgaaactaacataagcgttgaacatctggctaatgttctttctgaaaaaactaggagcagtagctgggtggtggtgttcaaagccctggttactgtacatcacctcatggtgcacggaaatgaggtgagcgtaagcatgcaattgcaaaatgttcttggtttgtcaagggcttactaccttttactttaattagtggcaagtgagagaagtgaatagcagtatgtatttaaaatatttttatctgtttttattaatgaatatatctttgtgatcagtattctttgaggtgtatcattttagtcactgatgaaatagccactggataacaatgtccataatagagtggatatttctgtcaattctttagaggatttagaccccaaaaagccccttagaaatgtgttacctcatacttgctttactttgacaggagagactacacctaagcatattacctcatcacctacccatctctctatattttacagaacaactggaatgctccataacattaaattacttattattttctactttaaattcacaggcattttccctcagtaagttttgtattaaaaaatcagggtttagaaattgactggattttgaaactcattataaagcaacagtaattacacagcagagtactggtaaaaaatagaacatatatataaatggaacacaatagagagcttggttatagaactacacttatatgggaacttggtggcactaaaaaatgtggggaaaagcatgggggaaggaatttaaaataaagcctattggcacaagcagcatccctatggaaaaaatgagaatgagatgcttatgttaccccatatacaaaaataaattccacatggatgaaatatctaaattcaaaaaatagataaaattgaagaaaatgtaggagaatatgcttatgacatttgggtagggaaggcgccatagttaaaagaagatatttgcaacatatatactatagactaaaggttaatattcagaatacataattagtaagaaaaaggcactacaatagactaatgagcaaaagaaatgaacagagggtttatagaaaaggaaaacagaatgtctaataatcatctgagaacatgctcatattagcaaaaattaaaatttctgacagtatgaatagttgggaggacattgaggtaatgggaattcacatactctgtggatacatgtagctgctgcagtttatcactgtggagcggagaacattgagacacatttagaaagttgaaaatgcccatcccagtgactcagcaaatccacttctcacatcatgtttataataatgaaaaactagaaatcacctaaatttccatcactagagaacagataaaatttagtgtagttatacaataaaatgctgtattacattaaatgagattgtataccagtaaggctagacctcaaaaacaatgctaatagaagaagcaaattgtagaatgacacttagagtgcaaaactacttacgtaaaaaatttaaaatacacacagtacttgtccatggaacaaatacatgtgaaactatgaggaaaatagattataaagataatgcattaaaattatgataccagttacttctaggtagaagcaggaaatggatctcagggatggggctttatccgtaatcatttattttctcttattttaataatagacttgaagcagatatgtcagaaagttagcagttatcatttctaggtagtggggtccacagatgtatcatattattatttgtatacttccgtaacttaaaattactcaaaatcaagagtggggcatggctaaatagaaagtcttagagggaaacagtgtgtattcacatgagctttaatgtttaactccttgtttatttggggggtatataaatagaggagagttggcagctgcaaatctttatgttggccagcacaggatgtgattgtgcgcaacttaatcaatgttcctgaaatagatacaaggtgaacgatagaattaagtatacattcataatgacaatcattaaggaactttttgtgtgtacagaaactaattttagaatttggcacatttgtttgacagcgtttcattaaacatgtttcatgtcagagctctttgttcactttacacaatttcctggataaaagtgtcatagaaggtaagatgattctttgatggaaatatttccatatgccaaagagggaaaagttctgaaaattgtgcctagttaaaaaagtgtctaaattatgaaggctgcgatgtgctatacattttaagaatgtaaataatccccaaattcattgatacaacgtatatttggagcttactaagaataacagaatatgccatatgctagagacagaaaagttaatgagacctacaggtctttgctcagtgaagccttgtccagcctaccaaaaattgcagcacctttacaccagttctctgcctgggtttattctttccccttctccctgactgtctctgtgttccttttttttttttttttttaacataattgtctgtcatttcccattgaaatgtaagccctatgagggcaggaatatttgtctgtttttttcactgctgaacttccagcacttaatacatcgcctggcttatagtaggcactcagtgattgtttaatgaatgaataaattgaaggggaatcagcatacatttggaggtcgagtagagagtagttgagtttgtaccatggcctttcttctcctttttctctatgaagtaggctgcaggtcatttgctgagtggagggagaggggaggagggatggtggcagtgggatgacgagagtaaggaaaatgctaacaatttataatagtttctgtgaaaatgtcgaaggagctgatacagttcaattatttcatctgttcaggaatgtcaccatcaatatcccattaagggatgatatcaaagctctaaggaaataaaaattaatctttaacagaaagctggaagaatgttggagtaggtgattaataaaggccattctagcttttgtgcttcaaagatattgttgaagtatacaggtgaatgtggaataagtctttgcatttattgacatattgtaaaaagctactgttggttgaattggaaataatcgaaatatctcatttttaggctatactatgtcaacttcatcagacgatacagcaagtacttgaatgaaaagtcactcgcatatagaatgatctcatctgacatcacaaaaaccaagagagggtcagtaaatatcattagtttgtaagcaagaagtactgaagcttacatgtggcctgctttgtagtttgtcaaaaacagccctatttcaagatgctgatgtcacagagcttctcaaactcttaattattgaggttcatgaatttcttttatcttttataggacagattgtgtgataagaaactatgaatactgaagagctgctaaacacacttccagttattcaaacccagtttaatgcaacataagagctttataaattttgttaaaaaatatagtaaatagcatcctgtaactataggtaggagaaataattttctaactgtggtgttaattggttacgtttttatttaattttcaggcaaatcctgatgaactaactaatggtataatacatgctgcttttatgctcctctttaaagattctctttgtctctttgcagcttataatgaagggatccttaatctgctaggtaggataaagaataagctttttaaatgattactttttaaagcataaaatggtaaaataatttatttgtaaaaatcccttgtctctacatttagactcacatttgttttagatacaaaatagaaaatctttgcagggtcatgtatacttttcaatacaaatattatattgcttcattggttaaacattatttggctaattagctacaaaacttttccacttttatgtaagtgctaactgatatttctgggaaatttgtcagggaatcaacctaggttgccatgtttattcattatatggtaataaggcccatttccaccaagttcaaataacacagttttgactttcctaagaaggtaaagcctataacataagtaattgttattgatgatatacaagcatatatttttagacttttcaggaaattactgtcatcatttagccctaatgaatgattcatttagctgcaattattctataaactttattgacgggaatttgatagctttccttatactgaagaaatacgtagtattatacatttgtagggttataagagagtaggaaacacagctctttccctcaaagggttgcagagctttgtattaatcaaaaagactatagactagaagtcgttgaaattaaaatctaaactatctgtgcatgctattaaattccatatacccagcaccagtatttggtatacagtagttactccataaaaaatagttgattatggggatagagcagtgctatttcttgttattaaaacagaaaataacttgattaaaattataattgttttgaacaggttaaattcatatccagaattagcttaaaatagaataatcagaatggagtaaaacttgaaaattgctaagatattggctcctttatggtaatttttttctatttttagacaaatattttgacatgaggaagaaccaatgcagggaaagtttggatatttacatcaggttccttagaggaacaaccaaattgacacagtttctgaaagttgcagaggtacagaaatccatttctacttaaggtgtttctttttttgcaataatttagtatcacttgaaactatacctctttcctccaccaccataaccacacaaacgcacagaaattggtagttgttttaactactttgtaaacagtaaaactaaaactaaaactaaagttaggtacttcaaatgtactatccaatgcacttgcactcaaaagcaatcttacaaggacttctgtttgcagccataaagataaccagtatgaagcttaccctcccaccagaaacaactctaaaagtagaccaaaatatatatgacataagtctttttaggtagtgaacaataggtaggtttgtggtcagtgacagaaacacttgaggtgagccccatgttctccctgacactcagagaacccaagcaggataaatacaaagagaaccacacggaggcgagtgatagtcaagcttctgaaaaccaaagagaacaaagacatattacccatgggagaatgacaatacgaataatcgctgacttctgactacttgaaaaattagaacacgtttgtatgatatccaaaatgcagcttagctcttcttaaatcagcaaagactcaataagctggaaaccatcattctcagcaaactaacacaagaagagaaaaccaaacaccgcatgttctcgctcataaatgggagttgaacaatgagaacacgtggacacacggaggggaacatcacacaccggggcctgtcaaggtgtgaggggttacaggagggacagcattaggagaaataactaatgtagatgatgggggttgatggatgcagcaaaccaccatggcacgtgtacacctatgtaacaaacctgcatgttctgcacatgtaccccagaacttaaagtataatgaaaaaaataaaaataatttaaaaagtctatccttaggataaatataagggtgtccttaagtgtgcgaggcatactttagcctgataaggtaccagcccaggaagacatcatactcttggggtattttctctttcatgcacacaatgatctctcagttacatttttgttgttgccactccctgctgtaacgtgtactttccccctcttttttgtttcagcaagttggaactgaccagagcaacaacattccatatattactcaggtcagtgtatctctcctatgtatttaagtgacgtttttgtctttgtttatgtgtgtttattatattaatcatcatctgagactctccatcctttgctatatacttatgtgtgtgcgttttcatttctccataagtaacatatatatgtgtgcttattatgtgtgtgtgtgtatgtgtataacagctagaccatgctttcaatattatcagtagaaacagcagggtatttggaataaagaacttagatttgaggactgccctgtccacctttcaggtatatggtctcaagcaactcatttccattctctgttccttatttctgcaactgcaaaatgggtatgatgcaccacctggctcatagtagtgttgtaagaatcaaaggagctcaggctttttttcttcctcagcaactagttctcagggatcccctcatgggcataggtgtgatctggggtagaggtggcagtgctggaggtgtggacaagatgggcctcaggcaacctgcttgtggatcctacttagccctctggacctgcctgtgctccaacccagatatatcatggggcctgagcagcacggcttctggtccagcctgtacctactacagagccctttcctactctgggcccccaaatttaggtggcaggcctaaattttaggccacctgggatatggatgagagcagttttccctcatgtgggaatatgctgtctccagagcccaaagaagcctaccaggtatcatgtatccttttttgttgtgggaggtacaagatgcaatactttatcttttattttggatgtgatgtcctggtatgcctctgaccactggaaccccccaaattttatcagtgtgaaaagaaggtagactgcatgtatctttcactatactgcccactgcctgctcatctgatcctatgagcatgacatcatggatacagtggatcaatttcatgctctgaggagtgaccagatgttctagacttctaactttattatgacagaagataagagagttaacacagccatgggtataaaactgaaaatgtaaagtgttgttcattccatgtgcctgtgaactctttccgagtcacacttctgatggtgatagaaagcaacacagtcaccaaaccagcagccacatactatgtacctaaagctgcattaactccacctctaccaaagaagctatcatggctggcatagtggctacaattggggtactacttgattgattttgctgtagttgttaatctccagaacccaactggttttgatggggaatggggactatcaccactaatataatcctttctgctatttagatttgtgctaatttctgccatcctcttgggaggtagtcctgtttttgtttttgttttcgtttttgttttgttttgttttaatctactgttttgcttggagggtgattgggggctatatcagaggcacgcccctagatgagttttgctgtggcttaactatagttataggcctagaggacaggaatggaggtgggagcagatcctgatggggcatgtaacttgtggagtagaggcctctgtatcatctccaacaaaggaggctcagaggtttctggaaaatctggagactcaagactttcaaagccattccccagctgtcctcatcctacatatcagcgactggtgtggcagacctgccttggttgggactagaagaatgaaggattatctgagataacacatgtggaatgctcagacagtgcctggttcatgtggcagtcatgtgtatgtgaagaagcctgtgaagagagagaaaatgaagatgtaggggagagaggatggttgcagatgcaaataaaatgttaggtttagtggcagagaaggagggattttttggctgatggcttataaatctttgaaggaaaggaatgttctctcaagtatacacagcacaaatgttccttcatgtgcagacaagtacaaaggcagcttgcacgtagccctgaaatcccacaaagtggtccacaatgggaaccactgttgggtgaaataatgcatggcttcctgaatgagaactcagatgaccagtggtgggaagagagagagacaatgagaatgtctgggttagtaggggaaaagacagagtttcattgcctcatggcgacataaccagttgatttcaatcaacattcattcgtaaacatgcttgactccttttcagttataatgaatgagacacaatcccggcccctgagttcccgaaaaagactgaaccaaaattacacatgaagaatcactaggtatccatcacaatgtagtcctctgacttttttctacattgacctttcttccctaagggaggtggtgggggcagcaaggggacctttgctaggaaccacagtctcagccattgtcaggatgccgatgagcattaactgaccagcacctgtgcttagagttctaagggacatttgccaggaggagtacctgaatggagagccacatttcccaccagtccaccctcctccttacctcagctctggtcttcctgagatcaaaaatgaagtagatggttgcaggagagcctgcaaaaggcaggcagggatcttgttggtaaactttcatgcagattcattcctttgtaaatcaaccctttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataacatgtttccaacattgttcacatactgacaacttttgttattcattctctcagaattgttccttagctgtgtccgcacctctgtaagtagtacattaaacctgctagctcagcagcttatatcacccatcttccgcccagatctgcttctctttctgtgtacccttctcatccttgatactctctccttccactcgcctttacaatccaacactgaatcctaacgactttgtctgcaatgcctcctcttttctgcattttagcttcaacttccatcctctctcaccttccaaccagtctgtctccagatactctgccccctgctgtttgttttacacagtgcatccagaatgcagatctgataacatccaaaatagagatctgatcatttcacctctcactcaaaagccctcgaaggtctcccaggattcttaggacaaagtgcaagctcctcaacattgcttttaatttaaggtcctgcattgttgaaccctttcctactctccagcttcatctcccttatgctcccctctgctgtttctgctctagcaacagggttcatctgtgccatatgccttccccagggcctttgcacatgttattcctctgtctacagtgctctttcttcccgaactgacctactacttattcctcagctatccttcataaggataagtatacacagcacaaactattactttcttcaggagggcttgcttccctgacttccctgacttggttagattcccctgcttcaacagtgagtattgtgtacctctctttcatgctactgtttacaacttaaaatgactttacatttatttgtgtgattgtttgatatatcttctccttatctgtagactgtaatcttatgaagcttgggatcaagttgtttgtgcttatggttatatccccatttcttattggtaaattatcataaatatttcttgaacaaagaatcagtgaatggttcaggggagttggtggaatatagaatcctggtgaggaattggccttatataagagggagtctattgtttctagttttttttaatttttttcccataggtttctggggaagagttggcatttggtgacatgagtaagttctttagtggtgatttctgagattttggtgcacccatcacccgagcagtgtacactgaacccaatttgtagtcttttatccctcacctccttcccaccctttctctcaagtccccaaagtccattgtatcattctgatgcctttgcatcctcgtagcttagctcccacttgtgagtgagaacatacgatgtttggttttccattcctgagttgcttcacttagaataatagtctccaatcccatccaggtcactgcaaatgctgttaattcattcctttttatggctgaatagtattccatcgtatatctataccacagtttctttatccactcgttgattaatgggcatttgggttggatccacattttttcagttgcaaattgtgctgctataaacatgtatgagcaagtatctttttcgtataatgacttcttttcctctgggtagatgcccagtagtgggattgctggatcagatggcagttctacttttagttcattaaggaatctccacactgttttccatagtggttgtactagtttacattcctaccagcagtgtagaagtgttccgttttcaccgcatccatgccaacatctattatttttttattatggccattcttgcaggagtaaggtggtattgcattatggttttgatggacatttccctgataattagtgatgttgagcatttttccatatgtttgttgtccatttgtatatcttcttttgagaattgtctattcatgtccctagaccactttttgatgggattttttttcttgataattcgtttgagttcattgtagattctggatgttagtcctttgtcagatgtatagattgtgaagattttctcccactctgtgggttgtctgtttactctactgactgttccttttgccattggaaagctctttcatttgattaagtcccagctatttatctttgtttttattgcatttgcttttgggctcttggtcatgaaatccttccttaagctgaggtctagaagggtttttctgacattatcttctagaggttttatagactcaggtcctaggtgtaagtctttgatccatcttgcgttgatttttatataagatgagagaggaggatccagtttcattctcctacatgtggctagccagttatcccagcaccatttgttgaaaaggttgtcctttccccacttgatgtttttatttgctttgtcaaagatcagttggctgtaagcatttggctttatttctgggttctctattctgttccattggtctatgcatgtatttttataccagtaccatgctgttttggtgactatggccttatagtatagtttgaagtcaggtaatgtgatgcttccagatttgttctttttgcttggtcttgttttgggtatgcaggctctttttttggttccatatgaatttttggattttttttctggttctgtgaagaatgatggtagcattttgatgggaattgcattgaacttgcagattgcttttggcagtatggtcattttcacaacattgattctacccatccataagcatgggatgtgtttccatttgtttgtgtcatctatgatttatttcaggagtgttttgtagttttccttgtagaggtctttcacctgcttggttaggtatattcctaagtattttatatttttgcagctattgtaaaaggagttgagttcttgatttgattctcagcttggtcactgttggtgtataggagagctactgatttgcatacattaattttgtattctgaaatttgctgaattcttttatcagttctaggagtttttggagggatctttagggttttctaggtatacaatcatgtcatcagcagatagcaacagttcgacttcctctttaccaatttggatgctgtttatttttttctcttgtctgattgctctggctaggacttccagtactatgttgaatagaagtggtgagagtgggcatctttgtctcattctggttctcagagggagtgctttcaacttttccccattcagtactatgttggctgtgggtttgtcatagatggcttttattacattgaggtatgtcccttgtttgctgatttttgctgagggtttttatcataaagtgatgctggattttgtcaaatgcgttttctgcatctattgagatgatcatgtgatttttgtttttaattctgtttatgtggtgtatcacatttattgacttgtgtatgttaaaccatccctgcatctctggtatgaaacccacttgatcatggtagattatctttttgatatcttgttggattcagttggctagtattttgctaatgatttttgcatctatgttcatcagtgatattggtctgtagttttcttttttggttatgtcctttcctggttttggtattaaggtgatactggcttcatagaatgatttagggaggattccctctttctctatcttgtggaatagtgtcaataggattggtaccaattcttctttgaatgtctggtagaattcagctgtgaattcatctggtcctggactttttttgttggtaattttttaaaattaccatttcaatcttgttgcttgttataggtctgttcagggtgtctaattcttcctgatttaagcaaggagggttgtatctttccaggaatttatccatcttctctatgttttctagtttatatgtgtaaaggtgttcatagtaggcttgaattatcttttgtattgctgtggtgtcagttgaatatctcccattttgtttctaactgagcttacttggattttctctcttgttttcttggttaatcttgccaatggtctatcaattttatttatcttttccaagaaccagctttttgtttcatttatcttttgcattttttttggtttcaatttaatttagttctgctctgatcttggttatttcctttcttctgctgggtttgggtttggattgttcttgtttctctagttccttgaggtgtgaccttagaatgtctatttgtgctcttttgggctttttgatgcagacatttatggctatgaactttcctcttagcactgcatttgctgtatctcagaggttttgataggttgtgtcactgttgcctttcaggtcaaagaattttttaaatttcaatcttgatttcattgttgactcaatgatcattcaggagcaggttatttaattttcatatatttgcttgattttgaaggttcattttggagttgatttccagctttattccactgtggcctgagagagtacttgatctaatttcaattttcttaaacttattgagacttgttttgtggcctatcatatggtctatcttggagaagtttccatgagctgatgaatagaatgtatattctgcagttgttgggtagaatgttctgtaaatacctgttaagtccatttgttccagggtatagtttaaatcccttgtttctttgttgactttctgtcttgatgacctgtctagtgctgttagtggaatattgaagtcccccactattattgtgttgctacctatctcatttcttaggtttagtggtaattgttttataaatttgggagctccagtgttaggtgcgtatatatttaggattgtgatattttcctgttggactagtccttttatcattatataatgtccctctttgtcttttttaactgctcttgctttaaagtttgttttgtcttttataagaatagctactcctgcttgcttttggtgtccatttgcatggaatgtctttttccacccctttaccttaagttgatgtgagtccttatgtgttaggtgggtctcttgaaggcagcagataggtggttggtgaattcttattcattctgcaattctgtatcttttaagtggaacatttaggccatttacatttaacactagtattgagatgtgaggtactattccactcatcatgctatttgttgcatgtatatctttttttttaattgcatttttgttttataggtcctgtgggattcatgctttaaagaagttctgttttgatgggttcccaggatttgtttcaagatttagagctccttttagcagttcttatagtgctggcttagtagtggcaaattctctcagcatttgttagtttgaaaaaaaactgtatttttccctcatttatgaagcttagtttcactggatacaaaattcttggtcaataattgttttgtttaaggaggctgaacatagggccccaatcccttttagcttgtagggtttctgccaagaaatctgctgctgatctgataagttttcctttctatgttacctggtgcttttgtctcacagctcttaagattctttccttcatcttaactttagataacctgatgataatgtgcctgggtgatgatctttttgcgataaatttcccaggtgttctttgagctttttgtatttgaatgtctaggtctctagcaaggtcagcaagttttcttcaattattcccccaaatacgttttccaaacttttagatttctcttcttcctcacgaacgccaactattcttaggtttggttatttaacataatcccagacttcttggaggctttgttcatattttcttattcttttttctttgtctttgttggattgggttaatttgaaaaccttgtctttgagctctgaagttctttcttctgattgttcaattctattgctgagactttccagagcattttgcatttctctaagtgcattcattatttcctgaagttttgattattttttatttatgctatttcactgacgatttctcccctcctttcctgtagcattttttgatttccttaaattggacttcacgtttctctggtgcctccttgattagcttaataactgaccttctgaattcttttcaggtaaatcagggatttcttcttggtttggatccattgctggtaagctagtgtgatgtttttaggggggcgttaaaggaccttgttttgtcatattatcagaattgtttttctggttccttctcatttgggtaggctatgtcagaggggctcaaggctgctgttcagattcttttgtcccatggggtgttcccttgatgtagtactctcccccttttcttagggatttggcttcctgagagccgggctgtagtgactgttctctcttctggatctagccacctagcatgtctaccaggctctgggctggtactgggagttgtctgcacagagtcctgtgatgtgaactgtccgcaggtctctcagctgtggatatcagcacctgctccagtggaggtggcagcagggagaaatggactctgtgcgggtccttagttttggttgtttcatgcactattttgtgtctgcaatatagtcctctagtctatttttaatggaaacagaataaaaagatacatccacattcattcagcaaatattaattaagcacttactatgtgccaggcacttaagattcatcagtggacaaaacagacaaaatccctgtcttcatggggcttatagtctattgcagggaaacagacagtaaacatatacagaaagaaatctgtaatgttaataaaaattagtgccttggtgaaaaataaagcttatcattaatgagactattggaagcccagtgtcttctgaggagatagatattttagcagttttttgatcttttaagagacttttttttgttgtttttaaaaacgtattttattttatttttttgagacacggtctcactctccagcccaggctgcagtgcagtggaacaatcacagctcactgcagccttgacttccctgggcttaggtgattctcccacgtcagtcttccaagtagctgggactacaggtgtgcgtcatcatgcccggataatttttctattttttgtagagatgaggtctcactgttgcccaggctagtctcgaactcctgggctccaacaatcctcctgccttggcctaccaaagtgttgggattacaagtgtgaaacactgcacctagcctaacaatatgttttaaatcatagtttgaaaatctgatttgataccaagatgctacttttaataatgaatttacatgtagcaattttagctttaatgaggcaccttaatttttgttcaaaatatttttatacagttgtccctcagtgtccacgtgggattgtgcaagtctctgatataaaatggtgtagcatttgcatataacgtacgcacatcctctgtatactttaaatcctctccagattacttgtaatgcctagtacaatgtaagcgctatgtaaatagttgttaaactgtattgtttaggaaataatgactagaaaaaaactttacatgtgcaatagagacacaaccatctattttgttcagaataccttccaacccatggttgactgaattcatggatgtggaacccatggatgtggaatccatggatatggaaggctgactgtaatatagaagagtatgaatttgctaaaactatcagaaaataagtgtttcataataactttttaggcaccccacagtttacttgaagcactaaaacagtatttagcttctttggaagagaaaaatgacactttacctccttactggtaagttaataaatgtcttaatgtaggttaattttgtttccctctagataatttcctgcgtcttgaatgtttaatgatatgcgatcgactaaataaattatgggctatgaatatgatggaatactattcagctattttaaatgatgatatgggaccgaggttttcagtcttttgtgggattccatactcttcgcaggatgatatgcttcccaaaggaacatcttttattaaactgaatgatttgcaaagtcagagattgggatgggaatattcaagaatttgattccttcacctaggggctcctttagtgagaataactattattgtagaagattatttaatgacgtgtcaaagtgctcattcatggaatagaacacatagtaacattcaagacgtgtgtatagatacacacatctgtctacacatacacatacatgtactctgctatatatgcatatacatataaactgaataatgcaaaatttgaggtatgtcaccccaaactgttcacattagctatttcttttttctttttctttttttttttttttttgagacagagtctcactctgtcgcccaggttgtagtgcagtggcgtgatctcggctcactgcaacctccaccacctgggttcaggtgattctcctgcctcagcctccccagtagctgcaattacaggcacacgccaccacaccctgctgatttttgtatttttagtagagacggggtttcaccatgttggccaggctggtctctaactcctgatctcaggtgatctgcctgcctcagcctcccaaagtgctgagattgcaggcgtgagacactgcaaccagccttagctatctctaagtgtaacaattatggttgatttccattttcttttttgtatttttcttttttttaaattatactttaagttttagggtacatgtgcacaatgtgcaggttagttacacatgtatacatgtgccatgctggtgtgctgcacccagtaactcatcatttacattaggtatatctcctaatgctatcgctcccccctccccccaccgaacaacatgccccagtgtgtggtgttctgcttcctgtgtccatgtgttctcattgttcaattcccacctatgagtgagaacatgcggtgtttggttttctgtccttgcgatactttactgagaatgatggtttccagcttcatccatgtccctacaaaggacatgaactcatccttttttatggctgcatagtattccatggtgtacatgtaccacattttcttaatccagtctctcattgttggacatttgggttggttccaagtcttcgttattgtgagtagtgccgcaataaacatacgtgtgcatgtgtctttatagcagcatgatttataatcctttgggtatatacccagtaatgggatggctgggtcagatggtatttctagttctagatccctgaggaatcgccacactgacttccacaatggttgaactagtttacagtcccgccaacagtgtaaaagtgttcctatttctccacatcctctccagcacctgttgtttcctgactttttaatgatcaccattctaactggtgtgagatggtatctcattgtggttttgatttgcatttctctgatgaccagtaatgatgagcattttctcatgtgtcttttggctgcataaatgtcttcttttgagaagtgtctgttcatgtccttcgcccactttttgatggggttgtttgtttttgtcttgtaaatttgtttgagttcattctagattctggatattagccctttgtcagatgagtagattacaaaaattttctcccattctgtaggttgcctgttcactctgatggtagtttcttttgctgtacagaagctctttggtttaattagatcccatttgtcaatttaggcttctgttgccattgcttttggtgttttagacatgaagtccttacccatgcctatgtcctgaatggtattgcctaggttttcttctagggtttttatggttttaggtctaacatttaaatctttaatccatctttaattaattttagtataaggtgtaaggaagggatccagtttcagctttctccatgtggctagccagttttccccacaccatttattagatagggaaccctttccccatttcttgtttttgtcaggtttgtcaaagatcagatagttgcagatgtgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttggttccatatgaactttgaagtagttttttccaattctgtggagaaagtcattggtagcttgatggggatggcattgaatctataaattatcttgggcagtatggccgttttcacaatattgattcttcctattcatgagcatggaatgttcttccatttgtttgtatccccttttatttcactgagcagtggtttgtagttctccttgaagaggtccttcacatcccttgcaagttgtattcctaggtattttattctctttgaagcaattgtgaatgggagttcactcatgatttggctctctgtttgtctgttattggtgtataagaatgcttgtgatttttgcacattgattttgtatcctgagactttgctggagttgcttatcagcttaaggagattttgggctgagacgatggggttttctagatacacaatcatgtcatctgcaaacagggacaatttgacttcctcttttcctaattgaatactctttgtttctttcttctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatccgtcccatcaatacctaatttattgagagattttagcatgaagggctgttgaattttgtcaaaggccttttctgcatctattgagataatcatgtggtttttgtcattggttctgtttatatgctggataacatttattgatttgcatatgttgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtatctctgccaggctttggtatcaggatgatgctggcctcataaaatgagttagggagaattccatctttttctgttgattggaatagtttcagaaggaatggtaccagctcctccttgtacctctggtagaattcggctgtgaatccatctggtcctggactttttttggttggtaagctattaattattgcctcaatttcagagcctattattggtctattcagagattcaatttattcctggtttagtcttgggagggtctatgtgtcgaggaatttatccatttcttccagattttctagtttatttgtgtagaggtgtttatagtgttctctgatggtagtttgtatttctgtgggatcggtggtgatatcccctttatcattttttattgcgtctatttgattcttctctcttttcttctttattagtcttgctagtggtctatcaattttgttgatcttttcaaaaaaccacctcctggattcattgattttttgaagggttttttgtgtctctatttccttcagttctgctctgatcttagttatttcttgccttctgctagcttttgaatgtgtttgctcttgcttttctagttattttaattgtgatgttagggtgtcaattttagatctttcctgctttgtcttgtgggcatttagtgctataaatttccctctacacactgctttgaatgtgtcccagagattctggtatgttgtgtctttgttctcattggttttaaagaacatctttatttctgccttcatttcgttatgtacccagtagtcattcaggagcagattgttcagtttccatgtagttgagcggttttgagtgaggttcttaatcctgagttctagtttgattgcactgtggtctgagagacagttttttacaatttctgttgttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagccgagttcaattcctggatatccttgttaactttctgtctcgttgatctgtctaatgttgacagtggggtgttaaagtctcccattattattgtgtgggagtctaagcctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttggcccatttacatttaaggttgatactgttatgtgtgaatttgatcctgtcattatgatgttagctggttattttgctcattagttgatgcagtttcttcctagcctcgatggtctttccaatttggcatgtttttgcagtggttggtacctgttattcctttccatgtttagtgcttccttcaggagctcttttagggcaggtctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagttactgccaagagatccactgttagtctgacgggcttccctttgtgggtaacccgacctttctctctggctgcccttagcattttttccttcatttcaactttggtgaatctgacaattatgtgtcttggagttgctcttctcgaggagtatctttgtggcgttctctgtatttcctgaatgtgaatgttggcctgccttgttagattggggaagttctcctggataatatcctgcagagtgttttccaacttggttccattctccctgtcactttcaggtacaccaatcagttgtagatttggtcttttcacatagtcccatatttcttggaggctttgtttgtttctttttattcttttttctctaaactcttctcgcttcatttcattcatttgatcttcaatcactgataccgtttcttccagttgattgaattggctactgaggcttgtgcattcgtcatgtagttctggtgccttggttttcagctccatcaggtcatttaaggacttctctgctttggttattctagttgtccattcgtctaatgttttttcaaggtttttaacttctttgccattggttcgaacttcctcctttagcttggagtagtttgattgtctgaagcattcttctctcaacttgtcaaagtcattctccgtccagctttgttccgttgctggtgaggagctgcattccttttgaggaggagaggcgctctgatttttagatttttcagtttttctgctctgttttttccccatgtttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcagaggctgcagaacagcggatattggtgaacagcaaatgttgctgcctgatcgttagactccccagaggtggagtctacagaggcaggcaggcctacttgagctgcagtgggctccacccagttggagcttcctgactgctttgtttacctactcaagcctcagcaatggcggccacccctcccccagcctcgctgctgccttgcagttcaatctcagactgctgtgctagcaatgagcgaggctctgtgggcgtaggaccctccaagccaggcgtgggatataatctcctggtgtgccgtttactaagactgtcggaaaagtgcagtattagggtgggagtgacccaatttttcaggtgccgtctgtcacacctttccttggctaggaaagggaattccccaaccccttgcacttcccgggtaaggcaatgcctcgccctgcttccactcaggctcggtgcactgcacccactgtcccgcacccactgtccgacaatccccattgagatgcacctggtacctcagttggaaatgcagaagtcattcgttttctgcgttgctcacactgggagctgcagactggagctgttcctattcggccatcttggctccacccctcttttttgtatttttctatattttcaacaatcactacaaaggtcacataatattaattcattagactttttaaggttgtattgattgtaatctatttatattatcaccttctcttagaccacaagcctattgactatttcttaattatctttatcacagacagacatatagttagtatatagttggagagatggatggatagatggataaaccaaagaaatgtaagttcagccaggcagaatatatgtaattctatttattatccagtgtgcctcatatttacggtcatcttttaagtcttcaacgtgcattgactacatccttcccaaatagtccagttgtgacagcttcagcaagcagagcttggtttgcaggtaatgtggcattattacatgattatgtaagtaataactgaagataggattagaatcttcaattttttttaattttattttactttatttttttattttattattattatactttaagttttagagtacatgtgcacaatgtgcaggtttgttacatatgtatacatgtgccatgctggtgtgctgcacccattaattcgtcatttagcattaggtatatctccaaatgctatccatcccccctccccccaccccacaacagtccccggagtgtgatgttccccttcctgtgtccatgtgttctcatttttcaattcccacctatgagtgagaacatgcggtgtttggttttattgtccttgcgatagtttgctgagaatgatggtttccagtgtcatccacgtacctacaaaggacatgaactcatcattttttatggctgcatagtattccatggtgtatatgtgccacattttcttaatccagtctatcgttgttggacatttgggttggttccaagtctttgctattgtgaatagtgccgcaataaacatacatgtgcatgtgtctttatagcagcatgatttataatcctttgggtatatacccagtaaagggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatatcctttgtccactttttgatggggttgtttgtttttttcttgtaaatttgtttgagttcattgtagatagaatctttaatttttttcactgctaaactaccagctgtgtctactgcctcttcctgaagcagtatttgaccgagcactttcattcctaggaatttattcaacatatatagtcaaaattgtgaaatgatatatgatcaagaatattcattgcaacattataatagcaatggcacaattaataagaggcttgcttttatataactgaaatgtaacaatctccaagttgtattgttaaatgacaaatgagcaagatgtgaaacaaagtatagtatactatcatttttattttttaagatagtaaaaagaaggaatatgtatgtaatgtcttaaataatacttctggaaggatatataagaaatgagttaaaatgggctgcttccaaaaagagtttggtggttcatggaaagagatgggtgggtgagtctccaccatataccattttctaacttttgaaattaataccatgaaaataattacctattattaatatataaagtttacaaagaaacaaaaatatacatccatacagtgtgatactttgtaatgcttaagatggaaatcctttgtaatttcttacatttagtttgcttcatacttaagtggtgttctggagccaactcctactagcttagaggagccataaatttccaggaatatttctagctggttgatgtcacattggcaacttgaaattggtcacgatgggagtatttatcctacagaaatgggcaaacactacaaattaagctttttttttttttttttggagccttgctctgttgccaggctggaatgcagtgcaatctccacctcctggggttcaagcaattctcttgcctcagcctctcgagtagctgggactacaggcacataccaccatgtctagctaatttttgtatttttagtagagatggggtttcaccatgttggctaggatggtctcaatctcttgaccttgtgatctgcctgtcttggcctcccaaagtgctgggattacaggtgtgagccactgcacccagcgtttttcttgagagctgtttgttatacatttattggcacacaactgctcataggcagccatattttggttatctctactctagacacaaatccacgtaataatgagcaatattatcatagggcttatatagcagtgttatcatagggtttatatgtatttgaattaaattttgttcttattttaacttaaatatttagactgtatgtatgttaaatgtttttatttttcttttatatatatatatattttcaatggacaaatcttctgcatttttaatggcgagttcaaccaaagctacgataaacataagttctttgcgtaaaacaatatgcatagaaaaactgtacacttggttcatttccaaaagaataactactgtcacttttctgagtccttgtgctttgggtattattagtgcttacaacagatgttacaagacagtttaacatagtggttaagagaataagctatggattcagttcgatgtgtatgtattctaaaggcctatgggcgtgattaccaacagaccaatactgactactggtgatctccacagtagtgtcaccctcattgcttcaaccaattctattgacaatactgtgaccagttgaaaccactttttatcttaaattactataatttacaaatgctggccatggagccagagtgcttggattcaaatttcactctgccattcatagactgtgtttttgagcagatcatttagcctctctgtacctcagcttccttatccttttaagattgctggcaaaattaaatgagttgatatacacagagtgattagaacagtgcctagcccatagtaagtgctgttattgttgtttttgtacttctatccttctatcactcttaccaacttattccatggtaaaccaaaagctctatccttggcagtttcactgaatgatttttctctatctctggccttggttggagatacttcccttagggttttaattactatgtatattctggggagagagaaagagagagagagagaattatatttctgtttacatttatatctacagctccaaacttatatatccagctgtctaatggacttttccacttgcatgttctacaattatctcaaactcaatttatccaaaatgaaatggctcacttaccgtctcccaaaccttgctcctttgcctttggcatgtgcttagtaaatggcactgttatccatttactcaggtgctcagttgataccagggaattatttttgatacttccttctccctcacttccatatccaacacattaccaaatcctattcattctactgctcaatgatctctcaattctctccacttctttctatccaaactgcctcaaccttagctaaaaccactgtcatttctctcttggattactataatagctacataactgccccccccacatccatttgccctcctataatccattctgaatatggcaatcagagtgatattttagaaagtcaaatataatcatgctattcccttgatcaaaacctttaagagaatttcagttatccaaggataaagcctacaagcttcatgttgtgttgttcttgctcaactttctgggatactggagttgtttcacttatttacacatcccccagggtctttctaattctcaggctggaatccttttctctccttcccctggccctaatcctcatggcctatataacttatattttatcctgtaagtctcagattaactaacacagaagactaattcttgactccctagatgaagttaaatttccttgatacattcatgtagtattctgtacttcttcttttataatattcaacaaattgtaattttactcagatcctgcaggatcaccgtgattcactttctcacatcctttaggtcattacttaaaagtacccttctcggtgagccattcctatttaaaatttaaattactgcatgcgccaaactaaatacataaagcaaaagttattagagatacatggagaacttgagaaaaatactactataacgggcaatttcaaaccatctctttcattattggacatatctctcccactgacatatcatgtctctttccctgatgttttttccttagcacttatcagtatctgacatagcatatacttcatcttggttgttttctgtctccattagaatgtaaatcacatgaaggcagggatatttatcttttttcctcactgctgtatctttagcacctactacagtgtctggcacataacaagggctaaattaaaatttattcaataaataactttaaatcactcttcttttacctaataatttgaggtcctgttagtttgtagtgggagggtacacatatatcattactctattgatataaacttggtttatgttttcatctcattttgtctcttatttttagattattttgactacatgatacattacaaccatcattaccttcacaagcccacgaacctattggagccagacagcaaggtggaacgattatagcaaacaacctaaatggctcacctgctagccttgtaggacataaacatctatttttaaattaatattttaaatatattttaaaatgcattttaagaaaaagtatttacacaaaaataatgtaaaccttctgtttgttttatgaaacagatttttacttcgaataaatcccagtcaataggtaagtttttattatttaaaaaaagatagagagggagggctgggcaggaaagaaaaaaaaaggcaaccaataaatacatgccagaggaaatggcttgtaagagtaagaactagaaaataattttcaaattagatatcataattgcttgttatgaaactctataacatgtggactttttaaacttaaataattaaagtggaaaatttatttattatgcactatcctaacttttgtaggtaaagttcttggttaaagtatactgtattacatggttctccacctacccatctgataatccttcttggctcatctgaaggatcttcttttctaggcatgtcttaaatattggcattcctcgtagttctttgtattcttggttcttttccttatgataatagactctattaaataaataatgcttatttttattttatcaagcaaaaataatgaatcaactagttggagctcctgagtatctatcataggttagccagtgtgaacttcagtgagttaactcctaaaatttcagccaaaaaaataacagggaaatggaaaccaaaggaaggcagaagtgataatattaacaacaagtaatatagaatgtaaggttaaaagccaggtaaagaggataaggataaggatttttaggccttatctgacaaaaagggcatgatctgatgttaatcagctaggggaaacagcaaggcctgtttcttcagattcttctctgtgatcctttgccttcagacataaggatgtttcttacctggatttttaggtctacctaaaaatccctcctttaaggataaggagggatatcatataacggtaaaaggcactatttatgaagacataacaatattaatgctgtagcactaagctaaatatagacagcaaaagttattagaaatacatggagaacttgagaaaagtataattataatggcaatttcagatcacttctttcattattagacaggtctagtagataaaacataagtaaagacgaaggaattcgaataaaacataataaataaataacaataataaaccagaacacacacacacacacacacacacacacacacacacacacacacacacacacagaacgttcattttctttaaagcaataatatacttggccacaaagaaaaccgtaacaaaattttgaagaattttacagtctatatctcataattcaataaaattagaactaattaataaaaatttgaccatgaaaattttaaccatttagaaatttaaaaatataattcttttgcccaagaggaaatcaaaaggaaaattattaactatctaaaggtaatgaagaagaaaacttcataccaatgctaatagggcactgagagagctaaaactcaagataaaaatttgtggctttaaatatcattatggttttaaaaagataaattttaagaaagaatttcatttttatcttaagaaagtagaaaataattaggaagataaaatttttaaagctaaaagcttaaattaataacactaccaacaaaaacagatacaaaattccttgtaaagtctaataaaataagctcctctgattaaatagaaaagagaatgcaaaagtttacaacattgggaataaaagagctgacagatggaggggagattaaaataattatgattgtgcaaccgtttggcaacagcctgtttgaaaatctagaggaaatggatgatttccaagtaaaatataaattactatataccgtccaagaagaagcagaaagatgcatagaccaattaccacataagtctttgaaaaggtagctgaagatctaccagtgcatcatgagttcacagttgagctatctaacccttaaagaataggtaatttcaattctatgccatagaaaaagggaagatctccaattcagtgtagaaagtgacataactttaatatcaaagctgaatgaagatgaacaaagaaaggaagctgctaactggtctcacgtattcattatatttggcagaatcctacataaaatattaacaaataaaatccaagaatatattttaaaaattcattgcttgtacagactgcttctttgatattcgagcatactctatgaaaccctgcctgagatgatacatttatagttttataatcttaagtatctagtaaagataatataagcttgattgactagtaaacctaggtataaaaaattgtatgcctgtattatatttaatgttgacaactctgaagatattccagtttttattttaccgacaatctttcttttaaaaatgtgtcttgaacatttatttatttttaattgacaaaatttatatatttatgatttacgttgtacaacaggtgttttaatatacattgtggaatgattaaacaaattaacatatcagcttcctcatatttttaattttttttttttgagacgaagtttcgctcttgtttcccaggctggagtgcaatggcacaatctcgactcactgcaacctccacctcccaggttcaagcgattctcctgcctcagcctcccaagtagctgggattgcaggcatccgccaccacacctggctaatttttttttaatttagtagagatggcgtttcaccatgttggtcaggctggtcttgaactccttacctcaggtgatccacccacctcagcctcccaaagtgctgggattataggtgtgagccaccatgcctggccattttaaaccattttttttgtggtgcgaacatgtaaaatctactttcagcaattttgaatattcaatacactcttattaactacaatcaatgtgttgtacaataggcctcctgaacttactcctctgtctagctgaagttttgtatcctttgatcaacatctccccaatcccttttctccccaggcctcacagcccctggtaactacaattctactctctgcttctatgagttcaactttttttagattccacatataagtgatatcatacagtacttatctttctgtgtctggcttatttcacttagcataatgtcctccagtttcatctatgttgttgcaaatgtccactatcactattctagaccaggccacttgagacctcttgtttggatgacttgaaaagatttcctaactgacttcttcactctatcttacttgcccactattcatgttccatactcctcccagtctaatctttcaaaaatgtaaacatgatcatgttatagcttcagttccccactgaaagggaaggatttccttctttttataatgaaatagtatttaattatgtgtataccacactctctttatcagttcatccattgatggacacttgggttgattctgtatcttgactattgtgaatagtgatgcaatgaacatggcagtgcagagatctcctcaatatactgatttcgagtcttttggatatatacccagaagtaggattgctggatcatatggcagttctattcttagctttttgaggaaaaccacagttttccataatggctgtactaatttatattcccaccaacagtatacaaacgttctcttgtctccacatccttgccaacacttacctttcatctttttgataatagccattctgacagatatgagctgatatcttgtggttttaatttgcacttccctaatgataagtgatgttgagcattttttcatatatctgttggtcatttgtatgtcttcgtctgaaaaatgtctattcaggtcctttggccataattgggttatctcttttcttgttattgagttgtctgagttccttatgtattttgaatattaacccctcttcagatgtatggctttcagatattttctcccaatccataggttttctcttactcttttaattgtttcctttgctgtgcagaagctttttagtctgatttaattctatttgtttattttagcttttgttgcctgagcttttggggtcaaatccaaaaaattgttgccccaactaatgttatatagtttttcctctgtgttttattccagtatttttacaatttcaggttttatgtttaagtctttaatgcattttgagttgatttttgtatatggtgtgagataagggttcgatttcattcttctgcatgtgaatattacgttttcccagcactgtttattgaagagactgttcttttcccattagatctgacatgaagtggtgtcagccttcagagatggaaattaatgatggaataaactggcagttgaataccttcacctgcacatcaaccatatggaattccattgctgctcctcttccctacatggtaaaatttgtgctgtataattactctagttttttgatatatatatatataacatagaaaaattgtattaaggatgtaagtagaggaagaagtgttttctttttaatcatttttaatgtattacactaatactcgtaagtatattaaactatttcataaattgaaatgtgaaaattcacattaggatctctataaggcctgcagttctcttctcatcatagaatctacacttccactattttgctctacttttattgtgcacctattaggtaccatgcactgtgctaagtggtaaagacacagaatcaaataggaactaggctctactctcaaggagctactgtaagggtagatgaaataaagacattgaatattttaagtgctaagatggaacacttcagagggtatattgattaattttacaagtaaactgaacatgaggtaaaaggagatgaggtgaatctattgtatatttcaaaatagctagaaaataataatttgagtggttctaagataaagaaaagacaaatatttaaggtgatggatatcccaattaccctgatttgatctttacaaattatatgaatgtgttatcacatgtacccccgaaatatgtacatttattatgtatcaataaaaatttttttcagaaaggagatgaggtaaattgatagtcaccatgtagcgggattgataaggaactagagagaccaatggggttaggaggatatttattatttaggtgcaccagcccagttcggattaacatccaaaggactgagccctgaacaaagagttaagttaccttttaagcattttgtggggtggggagagatctgtgcagggggaagcatattacagaagcaagaaacaatgacagttattcaattaattgagacatgctttacatcatttcttactttttaaggaaaaacatgttttacgacttgagtttatctttttaatgaccttgcagctgcacagctagagaaacagggtcttcacaatgcctgggaaaggaggagagataaggctcactagccacagaaaaacagacagttaattttaaaggactccagctctttctctttctcagggggaattgggttttcttacatacaactgagtttctgcttacacattctttaatttctttttttttttttttgagatggagtctcgctctgtcgcccaggctggaatgcagtggtgtgatcttggctcactgcaacctccacccctccaggtttaagcaattctctgcctcagcctccggagtagctgggattacaggtgtgtgccaccatgcctggctaattttttgtatttttagtagagacggagtttcaccatcttggccaggctgatcttgaactcctgacctcgtgatccacccaccttggcctcccaaagtgttgattacgggcgtgagccaccgcgcccggccaaatttcttttaattcctgttccaaccagttgacaaatagggcaagggcatcacaagcagagggagcagaaaactacatggactattcagaaaaatgtaaacagcttaacatggctgtagcataatatatgacagatgcaataagagataaagctagagaggttaatagaggccagaactcataggaacttgtataagagtttatcttattggcagtggggagccaaagctataacatgatcatgtttacatttttgaaagattagtctgggaagagtatggaagatggatagtaggcaagtaagacagagcgaagaagtcaattagaaagtcttttcaagttatccaagcaggaggtctcaagtggcccggtctagagtagtgacagtggacattgaaagaaagagatttcagagatacacagatagaattaataggacttgctaatagattgaaagttgaaagataagatcccctatacattatatgcaattttaaaattcaaaaagttctggacaacaagtttacttacttagttaaggtttgtgacaaactcttttggctgcaaaatgttatctgaactataatgagtctatagtcactatttatgatcttgtttgcattttgctgcataaatattaatgcatttgattatagggtactatcccatcccccctgaggtgttacatcatatgttttatgtgcattttctaaattgtctttctaatgtacaaaacattgtgaatttcaaaacacttttgatcccaaggatttaaaatataggattgtggacctgtgctattttttgtatgattttgctttaaaacttccttgtttcatagatataacaaactgtacattaacttttgagtagatagtgacttttctttttctaatatccagctgagctatatctaggaatgaaaattttggtagggtttgggaagaaggaaggagtaactttgaagcatactgaggaaagttgtggctgtgctactgcaatagatttgaaaacaaggtaaggcaatttgagggaaatggatgcttagaaaatagacacagatgactaagaaatactagaaaaggtacagcaaagaaaggggtttgcagtaaagaagatgaaatgtagaaataacataaatatttagtttaaatttatatgcatagagctgttcatagtattctcttattttccttttaatcaatgtctatgcaaactgtagtgatctctactctttcatttcttgatattggtgatttatgtcttctctctctctcttttttttttttgccttgcttagaggattgatatggtttggctgtgtctccacataaatctcatcttgaattgtagctcccataattcccatgtgttgtgagagggacctggtgggagataattgcatcatgagggtggttccccccatactgttctcacagtagtaaataagtctcatgagatctgatgattttataagaggaaactcctttcgcttggttcacattctctcttatctgcctctatgtaagacgtgccatttgccttccaccatgattgtgaggcctccccagccacgtggaactgtgagtccatgaaacctctttttctttgtaaattacacagtctcgggtatgtctttatcagcagcatgagaacagactaatacaaggattataaattttagtttcagtgaattttctctattgatttttttgttttcaatttcatcgatttctactttttgttgtttcctttcttctgcttgatctgggtttgctttgctcttctttttctagtttcttggggtggaaatttagattatcaagttgatatttttctaatacaagtgtttaattttataaaattccctctaagccctgctttgatataaaccaaacattttattatgttatattttcattttcactcagtccaaaatatttcctaatttctctttgacccattatttagacatgtgttgtgtaatttctttcttttctttctttctttttttttttttttgagatggagttttgctcttgtcacccaggctggagtgcaatggcgtgatctcagctcactgcaacctctgcctcccaggctcaagcaattctcctgcctcagcctcctgaatagctgggattataggtgcccggcaccatgcctggctagtttttgtatttttagtgaagatggggtttcacaatgttggccaggctggtttcgaactcctgacctcaggtgatccaccttccttggcctcccaaagtgctggacttacaggtgtgagccaccacacctggccgtgttgtgtaatttctaagtgttggaaaattctcttatctttctgttattgatttctagtttaattcatttgtggtcagagagaatattttgtatgctttaaattgttttaaattgctaagttttgatttatgacacatgagatggtctgtttttgtgaacattgttgggtgaaatgttatgtatgtatgtaaacgtcaattagatcctgtaggttgattgcattgttctgtatctttgctgatttctgcaaagtccttctgtctagacatcagagtagagtattaagttcccagttattgtggatttgttcatttctcctttcagtctggtcagtttttgcttcatataatttgaagctctgttatttggtgtatacacatttaggattattatgtattcttggtggattgatccttttaccaataagtaatgttcccctttattcctggcaattttctttgctctgaagtctactttgatattaatgtaacagctttcttttgaatagtgtttgtgtattatatcttctctccattcttttagttttaagctgcctatatcattgtatttgaagtgagtctcttgtctatagtgcagagttggattatttttaaaatccattctaacaacctctgtcttttatttggtgtatttagagcaattgcacttaatttcattattgatgtttgtatttaggtctaccattttattattttccgtttatcccctctatttttgttgttgttcctctgtttcctctttcctgccttctgggttctttgaacatttgttttgtcccacaggacctgtggctggagtcacctcaaaagcaggagcagaggagttcccacaatggagtgccccaaactgtcctgagatgggactgtttgggattccaaagacagaagcactaagtgccagggtgatcagtccaaagcatggactggtatgtctgcagatacaggggcaggggatggagtttttattagggtttaacaaatttggctcagtcgtggggccagtttttttttttttttcagtgttttgggtaacaacctagatgcctttattagcacctgggaatgttcaaggccccagtttttgttcaggcctcctggcaaaaacctggagtgggctgggtcacaaagtgatcaagtcactctgtgattttctgtcaagactcggaaagaaagttgggggaactggggaagcccacaacaatttttagtatcccattttaatttatatattgtgatttgaattatatcttcgtgtagtttcctttaatgcttaatctggcaattaccaaacacatttcacagtgagtttagaatcaatatttgaccacttcagttggaatgtagaaacattagcaccatatgggtccagcttaccttcttccctttatgttatagttgtctatcgattacatctacatacatcgaaaaaccatgcagacaatctcacactttttgttatcaaccatcaaacatgttttatagaactcaagagtggccaggagcgatggctcacacctgtaatcccagcactttggaaggccaagatgggcggatcacttgaggtcatgagttcagaccagcctggccaatgaggcaaaaccctgtctctaacaaaaatacaaaaattagctgggcatggtggtgggtgcctgtaatcccagctgcttgggaggctgaggcaggagaatcgtttgaacccgggaggcgcagtttgcagtgagctgagattgtgccactgcactccagcctgggtgacagagcaagacttcatctcaaaaaaaaaaaaaaaaaaaaagaggggacaaatagtctagtataattacccagataattgacatttctgttgctcttcctttttcttgatatttcaagtttccttctggtataatttcccttgctacctgaagagcttccattagcaatggaagttctgctgttagcaatttcagctatgacttctcttatttttctttcacttgaggatggctttactccacctttattcctaaagcaaattttcactggatatagaattctggattgataattcttttctttcagcacttgaaaaatgtgccactttattctggcctctgtggtttctgacgaaaaatttacaatcatttaaatcattgttctcctatagcctatgtcatttttttctggggctgatttcaagatgttttcctttgtctctcattttcagaagtttggtgatgatgtctgggcatgggttttgggggagcatatgctgtttggagtctattcagcttgatccttcatttctatgtcttttgccacacttgggaataactggaaaattttctgctattatgtcttcaaatactttttcagcactgcgcttagtcactccttattctcagactccaataacacaaatactagatgtttagatgttgtaacactggtccctgaagctctgtttggttctttcaaatctttttttctgtccttcagtatgaatgatttctactggtctgtctttaagttcaccgaatctttgctctgtcatctccattctgttattgagtccttccatggaatattttaattgtgttattgtatttttcagttctaaactttccatttggtttttctctgtatcttccatttatttgataatgctttctattttaacttttgttgcaagagtgttcatgattgctcattcaattatttttataacaaccactttaatgtctttgtcagataattccaatatctgtgtcatctcatcattggcatctgttgattgttttttctatgcaaattgagatttttgtggttcttcatgtgccaagtaattttggattgcatcttgtacatattgactgttattttgtaagactctatcttttattaaattttatggaaaatgttgatatttgtgttttaacaggtgtttcacctgattaggtctaagcagctagttttagctgcttctctggtccctggttctaatgtcagctcagtttccacagcctctgtgctgttcttcaggtctgtcctgcatgtgcactactcagtggtcagctgtggacctgcacattggtttcttcactggtttagtaatcagagtctttgctatgctcaagattaaaaccacccatgcatggggacagtggtagtgagccaaggagtcataaagtttccctttggtatttttcagtttcctggtcagaaaccacccacttctgtgataaagacaagtcaaggttttgagtggtggtaggacagagacagatttattaaaaaacattttttgtccctgcccttatggagccatagctccacctaatggaaatgaatgtttccctccctcagatagttggctcttgcagaacagtatttgtcctattgtttcttttactcagcattatatctttaaggtttatccatgttgtagcatgtattagaatttcattttcaaaattaattaattaaattgactataattgtatatatttatggagtatgatgtgatgttttgatgtatgtacacattgtagaaagattcaatcaaactaattagcatattcatcacttcacctttttaacctttttttttttgcagtgagaacatttaaaatatatccttttagcaattttggagtatataatacattattaactatgttcaccatgcagtgcagtagagcactaaaacttattcctcttgtctaactcaaactttgtaccctttgaccaacatatctcctttccccatccctccccacccttcatctctggaaactaacattctatgagattgacaaaattttagattccacatggaagtgagatcatgaagtgtttgtctttctgtgcctggcttatttagcttaacatgtcttccaggttcatccaggttgttgcaaatgacaaaattttgagataacggtccaattttattcttccgcatgtggatatctagttttcccagcaccatttattgaaagcactgtcctttccccattgtatgtttgtattagtccatttccacagttctgtaaagaaatacctgagactgggtaatttataaagataagaggtttaattggctcatggttctgcaggctgtacaggtagcatggctggggaggcctcaggaaacttataatcatggtggaaggagaaggggaagcaggtacatcttacatggccggagccagaggaagaaagtgagagggaggtgctacatacttttaaacaaccagatctcatgagaattcactcactatcatgagaacagcaagagggaaatccatctccatgatccagtcagctcccaccaggcccttcctctaacactggagattataatttgacatgagatttgagtggtgacacaaatccaaaccacatcaatgttcttggcacctttgttgaaaatcaattgactgtaaatgcatagttttatttgtaggctttttatcctgttccattggtcaatgtgtctacttctatgccagtaccatagcatagaagttttgattatcatagctttataatacagtttgaaatcagacagggtgatgattccagctttgttctttttgcacaagattgctttggacatttgagttttaaacaatggttccataatatataacatttgtttatccattcatctgttgaagaacatctgggttgtttcaaccttttggcaattgtgaataatgctgccatgaatattagcgcacaaatacctgtttgaatctttcaattcttttgattctatatcctgaggtggaattgctggatcatctggtaatttcatatttaattttttgaggagccaccataccatttattacagcaactgtaccattttacatttccaccagcaacatatgaaagttcaaatttctccacatcctcaatacttgttatattctgtgttttttgggagtgggtgattttgatgacagctatcttagtcagtttgagctggtataataagttgccatagactaggtggcttaaacaagaaaaatttatttctcacaggtctagaggctagaaaatccaatattaaggcactagtagatttattgcctggtgaaggtcctcttcttggtttccagacttcttgccgtacccatcacgtggcagaaagagagcaagagtgctctctgtggtcctttatattccactcatgagggtcccactgtcataacctaattacctcccaaaggccccatcacctattacctattacctattaccatcaactattaatgtgatggtaatcacattaggcgttaggatttcaacatatgaatttgggggagtggacaggaatattcagtccataacaatagccatactaatgggtgtgaagtggtatctcattgtggttttaatttgaattgccctaatgattaatgatgagcatcttttcatgtgattacttgccatttgtatgtcttctttgaagaaacttttgttcaaatcctttggtcattttttaatgtggttgctttggtgttgttgacttgcagaagttctttatatattttggatattaaccctatatcagatatataattagcaaatattttcttttattttatgagttaccttttgactctcttaaaagtgtcctttgattatacaaaggtttttaattttgataaactccaatttatctatttttccttttgttgcctatacttttggtctcaaatccaagaattcattgccaaatccagtgtcatcaaagttttcccctttcttttcttagaagatttttatagttttagttcttaaggttaggtctttgattaatttttagttaacttttgtccctggtatgaggtaagggcccaaattattcttttttttttgtactttaagttttagggtacgtgtgcacaacatgcaggtttgttacatatgtatgtatgtgccatattggtgtgctgcacccattcactcatcatttacattagatgtatctcctaatgctaaccctccctgctccccccaccccacgacaggccccggtgtgtgatggtccccttcctgtgtccaagtgttctcattgttcagttcctacctatgagcgagaacatgtggtgtttggttttctgtccttgcaatagtttgctgagaatgatggtttccagcttcatctgtgtccctacaaaggacatgaactcatccttttttatggcagcatagtattccatggtgtatatgtaccacattttctgaatccagtctatcattgatgggcatttgggttggttccaagtctttgctattgtgaataatgccgcagtaaacatacatgtgcatgtgtctttacagcagcatgatttatagtcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattgtaagtggtgtgagatggtatctcattgtggttttgatttgcatttctctgatggccagtgatgatgagcagtttttcatgtgtctgttggctgcataaatgtcttcttttgagaagtgtctgttcatatcctttgtccactttttgatggggttgtttgattttttcttgtaaatttgtttaagctctttgtagattctggatattagccctttgtcagataggtagattacaaaaattttctcccattccgtaggttgcctgttcattctgatagtaatttcttttgccgtgcagaagctctttagtttaattagatcccatttgtcaattttggcttttgttgccattgcttttggtattttagacatgaagtccttgtccatacttatgtcctgaatggtattgcctaggttttcttctagggtttttatggttttaggtctaacatttaaatctttaatccatcttgaattgatttttgtataaggtgtaaggaagggatccagtttcagctttctccatgtggctagccagttttcccagcaccatttattaaatagggaatatttccccatttcttgtttttgtcaggtttgtcaaagatcagatggttgtagatgtgtggtattacttctgagggctcggttctgttccattggtctatttctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttgaagtagttttttccaattatgtggagaaagtcattggtagcttgatggggatggcattgaatctataaattaccttgggcagtatggccattttcatgatattgatccttcctatccatgagcatggaatgttcttccatttgtttgtgtccccttttattccattgagcagtggtttgtagtactccttgaagaggtccttcacatcccttgcaagttgtattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttgtttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatttttttgagatccgtcccatcaatacctaatttattgagagattttagcatgaagggctgttgaattttgtcaaaggccttttctgcatctattgagatagtcatgtgattttttgtctttggttctgtttatatgatggattaggtttattgatttgcatatgttgaaccagccttgcatcccagggatgaagcccacttgatcatggtggataagctttttgatgtgctgctggattcgttttgccagtattttattgaggattttggcatcgatgttcatcagcgatattggtctaaaattctctttttttgttgtgcgtctgccaggctttggtatccggatgatgctggcctcataaaatgagttagggaggattccctctttttctatcaatttgattagtttcagaaggaatggtatcagctcctccttgtacctctggtagaattcggctgtgaatccctctggtcctggactttttttggttggtaggctattaattattgcctcaatttcagagcctgttattggtctattcagggattcaacttcttcctggtttagtcttgggagggtgtgtgtgtccagaaatttatccatttcttctagattttctagtttatttgtgtagaggtgtttatagtattctataatggtagtttgtatttctgtgggatcggtggtgatatcccctttatcattttttattgcatctatttgattcttctctctttcttctttattagtcttgctagcagtctctcagttttgttgatcttttcaaaaaaccagctcctggattcattgattttttgaagggttttttgtttctctatctccttcagttctgctctgatcttagttatttcttgccttctgctagcttttgaatgtgtttgctcttacttctctagttcttttaatggtgatgttagggtgtcaattttagatctttcctgctttgtcttgtgggcatttagtgctataaatttccatctacacactgctttaaatgtgtcccagagattctggtatgttgtgtctttgatctcattggtttcaaagaacatctttatttctgccttcatttcgttatgtacccagtagtcattcaggaccaggttgttcagtcgccatgtagttgagcgattttgagtgagtttcttaatcctgagttctagtttgactgcactgtggtctgagagacagtttgttataatttctgttcttttacatttgctgaggagtgctttacttccaactatgtggtcagttttggaataggtgtggtgtggtgctgagaagaatgtatattctgttgatttggggtggagagttctgtagatgtctattaggtctgcttggtgcagagctgagttcaagtcctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctgttttaattgatattatcaaatgtttttcccctcattctattaatgtggtgtattgcatcgatcgagttttgtatattgactcatcattgcattccaggaagaaatcccacttggtcatggtgtataatccttttcataaactgctggattcggtttgctggtgttttgttgaggatttttgcattaatattcataaagaatattgctctacagttttcttctattgtctttggctttggtatcagaatatagcagcttcatagaataagttaggacgtgttttctacgcttcaattttttggaagactttgagaagatttggtattaatttttcttttgatgtttgttagaattcgacaaacatcaatttcaatattcatctggtcccgggcttttctctttgggaagtttttgattactgattcaacctctttactaattatagatctattcagattttctatttcttcatgagtcagtatcttgtttatttttttaatcactacaaattaggcgtaagtatcattgttttatatagtcagtgtttgtttagatttaaacacattgtttaccattttctttctcataattccttcttctatcttagaccttctgtatgggatcacctgaagtacatccttaaaatttccactggtaagagtgtattgttggtcaactcaattttcatttgtcaaatttcaattttcatttggtatactcttttagtttgacagttattttctcttagtactctgaagatatcattctactatattctggcttctaccaccaccattgataaaacaactttcagtctaattatattagccgtgtaagcagaataatgcccgccacccggaagtcaacgtcctaatccatggaatctgtgaatatgcttggttacatggcaaagggaccttgaggttgcaggtggaattaagtttgctaatcaaatgactttaaaatcgggagattatcctggtgggcccaatataatcacaaaattccttaaaagtgaaagagggcggcaagagggacataaaaagagatgtgataatggaagcaagattaatgctacagttgctgactttgaagatagagcaagggggacacaaaccaagggatgttggtgacctccagaagctggaaggaacaaataaactgattctcccctggagcttctagaaggaatgaagccctgccaataccttggttttagcccaatgagatccatgtcagacttctgaactccagaactgtaagcaaatacatttgtatcatttaagcccataagtttcaagtaatttgttatagcagcagtggtaaactaatatagtgattctgaatttttttgctgtctttaaggttttgcctttttaataagtagttttaccttgatatttctacaggtagattggttcattgatagattgattgactgatttaacttgcttaaaatttattggggcttctggaatctgagaattatgatttttctcagttctaaaaattcttagctgttatacctgtaaatattggctttcttccttgccctctagtgtcttcactggcaagccaattagacttcttttatatcttttcaccctcctttttatctcttaagacctctctcctgtattctctctttatctctatgtgcttcattttggatattatctccaaatgtatattctactttatgaattctgtctgcatctatgtctaatttgcaatttagcccatccattgaaggtttgtgttcttgtaattcaatccttctgttaaagttttaatttcattagttatgcttttaatttccaagaatatattcttatgatctgttctttttcataacatcctgttcactttcataataaccttatttgtctctttttacagttttttacttaaagtctcttttctctgatataagtatagctactcttgctcacttttgtttttcatttgtgtgaaatatctttttccatcccttcactttcagtctatatgtgtctttacagatgaagtcagtttcatcaaaattattattgataagtgaggacttactcctgtcattttgttgttctctggttgttttgtatatcctttgtttctttcttcccttcttactgcttgtcattgtggtttggttgttttctatagtaataaggttgattcttttttgtttctttttatatctgctctactaatgagttttaatacttttgtgtgttttcataatgctgattatcttttcacttccagattcaggactcccttgagcatttcttgtaaggccagtctgttggtgacaaattccctcagtttttgctcatctcggaaaaacaaaacatcggttcgagcatcttttcatatatttattaaccactaagttccctttttaacgaaatacctacttaagttttcacctgatttttattgggttatttgtcattctcttattgctttatgagttctatacaaattctggatactattcctttgtcagctatttctttgtcccatctttttttctgtttgtgacatttctttttcaagaaagtattacttagtgttttaggaacatttttgattaaacatgtttcccgctatgagttctcagaaatttaagaaatacacaaaggaaccaggtgggaattaaaattcagatctcgctttacgacctaaaatatagaactttgcagtaaagctagattagagaagatagcaagggcttctacctacctcttcaaattgaacttactcccccagtcactcttgtgaaaactgtagaactggatggtggagacttcaaagggacaggaagttctgcaaagatgagccaacctcttaagaaggaagtagtaacagtgcatgccacttgctagcaagctttagaccaggaggactttatgtaatactgtagcttagtggttaagagtacaggctttggcagcagactgcctgacttggaaacgaggtagagcctacttaatatctgcgcgaccttggacaaagtacagaacctctccatgcctcagttttcttacctgtaagatggagattaatatggcacctgtcttataagttgttatgagggttaaatgaggtaacacatgtaaaatgctcagaatagtgcctaggtcacagttagcgctcaaaaaatatttgtaatatgatgatggtgatgatgatgatgatgatggagactatgtggcacagtcctcccgcccactaatatatgagacatagaccactaaattaaatcccctcagtcctcagggagggatatggaaataagagggcaaggagaataaccatttcccctaacaacaattaagatgctctgtgggcattgagaacacacgtggcatagttcccccttgacagaattttctagaaccttgctatactttcttattctcaagcttcaatattcatacggttcacctagaattcttaaaatgaagtgggtttgggatggagattgagattctgcatttcttttttgaaaaaacttttaaatttatttttaaatttttattttattttattttaagttctgggatacatgtgcaggatgtgcaggctcgttacataggtaaacgtgtgcgatggtggtttgctgcacctatcaacccatcacctaggtattaagccccgcatgcactagccatttatcctgatgctctccctcccctaacccctcctgcaggtcccagtgtgtgttgttcccctctctgtgtccatgtgtcctcattcttcagctcccacttataagtgagaacatgtggtgtttagttttctgttcctgtattagtttgctgaggataatgtcttccagctccatccatgtccctgcaaaggacatgatctcattcctttttgtggccacataatatttcgtggtgtatatgcaccacattttctttatccagtctattattgatgggcatttgggttgattccacatcttttctattgtgaatagtgctgcagtgaacatacatgtgcatgtatctttataacagaatgatttatattcctttgaatatatacccaataatgggattgctgggtcaaatggtatttctggttcttggtctttgaggaatcgccacactgtcttccacaatggttgaactaatttgtattctcccaaacagtgtaaaagcattcctatctctccacagccttgccagcatctgtcgtttcttgactttttaataatctccattctgactggggtgagatggtatctcattgtggttttgatttgcatttctctaacaatcagtgatggtgagctttttttttatatgttgtccacaacatataaaattgcttttgacattcttttgagaagtgtctgttcatgtcctttgcccaattttttatggggttgtttcttttttcttgtaaatttaagttccttgtagattctggatattagacctttgtcagatggatagcttgcaaaaattttctcccattttgtaggtggactgttcattctgatgatagtttcttttgctgtgcagaaggtctttagtttaattagaccccatttatcaatgtttgcttttgttgcgattgcttttgacattttcgtcatgaaatctttgcccatgcctatgtcctgaatggtattgcctagatttccttctagggtttttatagttttgggttttatatttaagtcttttatccattttgagttaatttttgtaaaaagtgtaaggaagggtccagtttcaattttctgcatatggctagccagttttcccagcaccatttattaaatggggaaccctttccccattgcttgtttttgtcaggtttgtaaaagatcagatggttgtaggtgtgcagttttatttctgagatctttattctgttccattggtctatgtatctgttttggtaccagtaccatgctgttttggttactgtaaccttgtactgtagtttgaagtcaggtagtatgatgcctccagctttgtttctttgcttaggattttcttggctatatgggctcttttttgattcgatatgaattttaaaatagttttttctaattttgtgaagaatgtcaatggtagcttaatgggaatagcatcaaatctataaattactttgggcagtatggccattttcacgatattgattcctcctatccatgagcatggaatgtttttccatctgcttgtgtcctctttaacttccttgagcagtggtttgtagttctccttgaagaggtccttcacttcccttgttagctgtattcctggttattttattctctttgtagcaattgcaaatgggaattcactcatgatttggctctctgcttgtctgttgttggtgtataggaatacttgtgattttggcatattgattttgtatcctgagactttgctgaagttacttatcagcttaagaagcttttaggctgagatgacagggttttctagatataggatcatgtcatctgcaaagagaaacagtttgacttcctctattcctacttgaataggctttatttctttctcttgcctgactgacctggccataacttccaatactgtgttgaataggagtgctgagagagggcgtccttgtcttgtgctggttttcaaggggaatgcttccagcttcttgcccataaagtatgatattggatgtgagtttgtcataaatgactcttattattttgaggtatgttccatcaatacctaatttattcagtttttaacatgaagggatgttgaattttatcaaaggccttttctgtgtctattgagataatcatgtgttttttgtctttagttctgtttatgtggtgaattacatttattgatttgtatatattgaaccaggcttgcatcctggggatgaagtgaacttgattgtggtgcataagctttttgatgtgctgctggtttctatttgccagtattttattgaggatttttgcattgatgttcatcagggatgttagcctgatgttttcttttttttagttgtatctctgccaggttttggtatcaggatgatgctggcctcataaaacgagttagggagaagtccctccttttcaattgtttggaatagtttcagaagaaatggtaccagctcctctttgtacctctggtagaattcagctggtaggctatttaatactgcctcaatttcagaacttgttattgatctattcaggaattcaccttcttcctggttcattcttgggagggtgtatgtgtctaggaatttatccatttcttctagattttctcgtttatttgcatagaggtgtctataaataaataatgtgtctataaataatactgtaaagtattctctgatggttgtttgtatttctgtggggtcagtggtgatatcccctttataattttttattgtgtctatttgattattctccctttatcctttattagtctagctagtagtgtattttattaactgtttcaaaaaaacagctcctggatttgttgattttttaaggttttttttttttgtgtgtgtatctatctccttcagttccactctgatcttggttatttcttgtcttctgctagctttggggtttgtttgctcttggttctctagttcttttagttgtgatattagggtgttgatttgagatctttctagctttttgatgtgagcatttagtgctataaatttccctcttaacgctgctttagcttcgtcccagatattctggtacgttatctctttgttctcattggtttcaaagaacttcttgatttttaccttaagttcatgatttgcccaggagtcattcaggagcacattgttcaatttccatgtagttgctgtggttttgagtgagtttcttaatcttgagttcttatttgattgtgctgtggtctgagagactgttggttatgatttcagttcttttgcctttgctgaggattgttttacttcctgttatgtgattgattttagagtaagtgccatgtggcactgagaagaatgtatattctgttgtttatgggtggagacttctgtagatatctatcagattcacttgatccagagctgagttcaagtcctgaatatccttgttaattttctgtcttgatggtctatctaatattgacagtgggtgataaagtctcccactattattatctgggaatctaaatctctttgtaggtctctaagaacttgttttatgaatctgggtgctctggtactgggtgcatatgtatttaggatagttagctcttcttgttgaattgatccttttaccattgtatcatgcccttctttgtattttttgatctttgttggtttaaagtctgttttgttaaaaactagaattgtggccaggtgcagtggctcacgcctgtaatcccagcactttgggaggccaaggtgggcggatcgtgatgtcaggagatcgagaccatcctggctaacatggtgaaaccccgtctctactaaaaatacaaaaaattggctgggcatggtggcgggcacctgtagtcccagttgctcgggaggctgaggcagcagaatggcatgaacctgggaggcggagcttgcagtgagctgagatcatgccactgcactccagcctgggcgacagagcaaggctccatctcaaaaaaaaacaaaaaacaaaaaaaaaaaaaaccagaattgcaacccctgctttttactgctttccactgcttggtaaattttcttccatccctttcttttgagcctatatgtgcctttgcacatgagatggttctcttgaatacagcacaccactgggtcttgactgtttatccagcttgccgttctgtgtcttttaattggggcatttagcccatttacatttaaggttaatattttcaggtgtgaatttgattctgtcatcaggatgctagctggttatttcacagactttttatgtggttgcttcatagtgtcattggtctttgtacttcagtatgtttttgtagtggctgataacagttttttctttccgtatttagtgcttccctcaggagctcttgcaaggcaggcctggtagtgacaaatttcctcagtatttgcttgtctgaaaaggatcttatttctccttcacttatgaagtttagtttggccagataggaaattctgggttggaaatgcttttctttaagaatgttgaatattggcccccaatctcttctggcttgtaaggtttctgaaaagaggtccactgttagtctgatgggcttccctttgtaggtgacctggcctttctctctggctgtccttaacattttttccttcattttgaccttggagaacctgatgattatgtgtcttggggttcatcttctcatggagtattttactggagttctctggatttcctgaatttgaatgttggacctgtcttgttaggttggggtagttctgctggatgatatcctgaagtatgttttccaactttgttccattgttcccctctgtttcaggtaccccaattattcgttggtttggtctttttacataatcccatagttctcggagcttttgtttgttcctttcattctttttgctctaatcttgtctgtcttatttcagcaagatagtcttcaagttctgaaattctttcctctgcttggtctatttggttattggtacttgtggttgcattgtgaaattctcatgttatgtttttcagctccatcagtattgggggaacccgcccccaatatttcaacataggttctttctattttccatacgtgtcggctggctgagaaataaagagagaccgtacaaagagaggaattttacggctgggccactgggggtgacattacatatcagtaggactgtgatgcccacctgagcctcaaaccagcaagtttttattaagggtttcaaaagaggagggggtgtaagaacagggagtaggtacaaagatcacatgcttcaaagggcaaaaagcagaactactaataaggatctaacaaagatcacaaggcaaagggcaaaagcagaactattgataaaggtccaacaaagatcacaaggcaaagggcaaaagcaagaaccactgataagggtctattttcagcggtgcacatgttgtcttgataaacatcttaaacaacagaaaacagggtttgagagcagagaaccagtctgaccacaaatctaccagggtggagtttcccaaccctagtaagcctgagggtactgcaggaatccagggcatatctcagtccttatctcaactgcacaagacagacattcccagagtggccgtttatagacctctccccaggagcgcattcctttcccagggtattaatattaatattccttgctaggaaaataatttagcgatatctctcctacttgcacgtccatttataggctctctgcaagaagaaaaatatggctctttttgcccgaccccgcaggcagtcagaccttatggttgtcttcccttgttccctaaaactcgctgttattctgttctttttcaaggtgcactgctttcatattgttcaaacacacgttttacaatcaatttgtacagttaacacaattatcacagtggtcctgaggtgacatacatcctcagcttacgaagataacaggattaagagattaaagacaggcataagaaattataaaagtattatttggaaactgataaatgtccatattaaaatgaaatcttcacaatttatgttcctctgccgcagctccagctggtccctccattcagggtccctgacttcccgcaacacattgggtcatttctgttcctctctaaagtggttattctggtaaacagctcctgtgatgatttatcatggttcttagcttctctgcgttgggttagaacatggttctttagctcagtgaagttcatcattacccacgttctgaagcctacttctgtcagtccatccatcttggcctccacccagttctgtgcccttgctggagaggtgttatgatcacttggaggagaagaggcactctggctttttgagctttcagcattttttttgttgattctttctcatcttaatgagtttacctagctttgatctttgaggctgctgacctttagatggggtttttatggggacttttttgttgatgctgttgttgctgttgcttcctgtttgtttttcttttaacagtcaggctactcttccatagggctgctgcagtttgcttggggtccactccagatcctagtcacctgggtccctcctgcacctggaggtatcaccaatggaggctgcagaacagcaaagatggcttcctgccccttcctctgggagctctgtcccagaggggcaccaacctgatgccagtgggaatgctcttgtataaagtgtctggcgacccctattggggggctctcacccagtcaggaggcatgggatcaaggacccacttaaggaagcactctggctgccccttggtggaaggggtgcactgtgctggggagaaatcttactcgtccacactgcctggattcctcagagccagcagggagaaagactaagtcggctgatccatggagactgtggctgcccctccccccaggggctctgttccagggagatcagagttctgtccataaacccctggctggagttgctgaaattcctgcagcaaggccccacccaatgaggagggttgggttagggtccagcctaaagaggcagtctgggctgagcgtggtggctcacacctgtaattccagcactttgggaggccgaggtgggtagatcacctgaggtcaggtgatataactgtgtctcatgttatatcacctagtaatggacaaagaaacaaagacagggattaaagttatgactggtattactcagcttttcatctgctgtgttgaaagccaacttatcatttttcacattattgtatacatctaaaagacatcataaacgaagactggaagtgaaaactgaaaaactgagaaagttttatttgttggaggtaatgtgattatggttgaaatttttatttaatttgtctattgttattgttttgtttatgcagtacagaaaagtcacaactctttctttcttagctaagttcacattactctctgatgtgcaatgttttccaagcaaattcctgttcctcaggaaatttgagctattgtgaactctgctctgccttctaaaacaacacagcaataattagatgtctttaaacctcttaaggaaagataattgcttaaggaaagatcactgtcttggctataaaaagttcactatgaatttgttctcaatgttaaacatatagcagaaaatgttctgtatcttttaatattgcttattaaatactagtagaaaatttactttttgtcaaggttctacctccagtgactccccagcaaatgcctatgtatagaatggtaagaaaaaacgctcttttttaatcattcatttgagtttattagaaaattttgagagctggcagccaagatggccgaataggaacagctccagtctacagctctgagcgtgagtgacgcagaagacgggtgatttctgcatttccatctgaggtaccgggttcatctcactagggagtgccagacagtgggcacaggacagtgagtgcagcgcactgtgcgcaagccgaagcagggcgaggcattgcctcacttgggaagtgcaaggggtcagggagttccctttactagtcaaagaaaggggtgacagacggcacctggaaaatcgggtcactcccaccctaatactgtgcttttccgatgggcttaaaaaacggcgcaccaggagattatatcctgcacatggcttggagggtcctatgcccacagagtctcgctgattgctagcacagcagtctgagatcaaactgcaaggtggcagcgaggctgggggaggggcgcccgccattgcccaggcttgcttaggtaaacaaagcagccaggaagctcgaactgggtggagcccaccacagctcaaggaggcctgcctccctctgtaggctccacctctgggggcatggcacagacacacaaaaagacagcagtaacctctgcagacttaaatgtccctgtctgacagctttgaagagagcagtggttctcccagcacgcaactggagatctgagaacaggcagactgcctcctcaagtgggtccctgatccctgacccccgagcagcctaactgggaggcacccctagtaggggcagactgacacctcacacggcggggtactcctctgagacaaaacttccagaggaatgtcagacagcagcattcgcagttcatgaaaatccgctgttctgcagccactgctgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacgcagttcctcaccagcaacggaacaaagctggacagagaatgactttgacgagttgagagaagaaggcttcagatgatcaaactactccgagctacaggaggaaattcaaaccaaaggcaaagaagttaaaaactttgaaaaaaatttagacgaatgtataactaaaataaccaatacacagacatgcttaaaggagctgatggagctgaaagccaagtctcgagaactacgtgaagaatgcagaagcctcaggagctgatgcgatcaactggaagaaagggtatcagtgatggaagatgaaatgaatgaatgaagtgagaagggaagtttagagaaaaaagaataaaaagaaatgaacaaggcctccaagaaatatgggactatgtgaaaagaccaaatctacaactgattggtgtacctgaaagtgacggggagaatggaaccaagttggaaaacactctgcaggatattatccaggagaacttccccaatctagcaaggcaggccaacattcagattcaggaaataaagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaactctacaagccagaagagagtgagggccaatattcaacattcttaaagaaaagaattttcaacccagaatttcatatccagtccaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgccaaattgtaaagaccattgaggctaggaagtaactgcatcaactaacgagcaaaataaccagctaacatcataatgacaggatcaatttcacacataacagtatcaaccttaaatgtaaatgggctaaatgctccaattaaaagacacagactggcaaattggataaagagtcaagacccatcagtgtgctgtattcaggaaacccatctcttgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattaggcagatcaacgagacagaaagttaacaaggatactcaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactgtctctcagaccacagtgcagtcaaactagaactcaggattaagaaactcactcaaaaccgctcgactacatggaaactgaacaacctggtcctgaatgactactgggtacataacgaaatgaaggcagaaataaagatgttctttaaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaagttaatgaatccaggagatggttttttgaaaggatcaacaaaattgatagaccgctagcaagactaataaagaagaaaagagagaagaatcaaatagatgcaataaaaaatgataaaggggatatcaccaccaatcccacagaaatacaaactaccatcagagaacactacaaacacctctgcgcaaataaactagaaaatctagaagaaatggataaattcctcgacacatacaccctcccaagactaaagcaggaagaagttgaatctctgaatagaccaataacaggccctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgagaccagcatcatcctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaagacctttgacaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaagcaggagaaggaaataaaggctattcaattaggaaaagaggaagtcaaattgtccctgtttgcagatgacatgattgtgtatctagaaaaccccattgtctcagcccaaaatctccttaagctaataagtaacttcagcaaagtctcaggatacaaaatcaatgtgcaaaaatcacaagcattcttatacaccaataacagacaaacagagagccaaatcatgagtgaactcccattcacaattccttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcagtattgtgaaaatggccatactgcccaaggtaatttatagattcaatgccatccccatcaagctaccaatgactttcttcacagaattggaaaaaattttaaagttcatatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaatggaacagagctctcagaaataacgccgcatatctacaactatctgatctttgacaaacctgagaaaaacaagcagtggggaaaggattacctatttaataaatggtgccgggaaaactggctagccatatgtagaaagctgaaactggatcccttccttacaccttatacaaaaattaattcaagatggagtaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattctcacaacctactcatctgacaaagggctaatatccagaatctacaatgaactcaaacaaatttacaataaaaaatcaaacaaccccatcaaaaagtgggcgaaggacatgaacagacacttctcaaaagaagacatttatgcagccaacagacacatgaaaaaaatgctcaccatcactagccatcagagaaatgcaaatcaaaaccacaatgagataccgtctcacaccagttagaatggcgatcattaaaaagtcaggaaacaactggtgctggagaggatgtggagaaataggaacatttttacactgttggtgggactgtaaactagttcaaccattgtggaagtcagtgtggcgattcctcagggatctagaactagaaataccatttgacccagccatcccattactgggtatatacccaaaggactataagtcatgctgctataaagacacatgtacacgtatgtttattgtggcactattcataatagcgaagacttggaaccaacccagatgtccaacaatgatagactggattaagaaaatgtggcacatatacaccatggaatactatgcagccataaaaaatgatgagttcatgtcctttgtagggacatggatgaaattggaaatcatcattctcagtaaagtatcgcaaggacaaaaaaccaaacaccgcatgttctcactcataggtgggaattgaacaatgaaaacacatggacacaggaaggggaacctcacactctggggactgttgtggggtgggggcggggggagggataccattaggagatatacctaatgctaaatgacgagttaatgggtgcagcacaccagcgtggcacatgtatacatatgtaactaacctgcacattgtgcacatgtaccctaaaacttaaagtataataataataaaataaaaaaaagaatgcttggaatcaattacacccaattgctgttaaatttctccaatttatcatgctataccttgcatgagtagtcaaagaggacatagtatacaaagtatataacacaaagatagtttgagtaatacggtggaaagactatatcacaagattggaaacaccctgggatcaagatcaaattctaatgatttgcacagctatcggaccttgtggtgtaacacatggattatgcattatgtgttagaaatggtttgtgaaggaattcatcgattttgtagcttgttttatttaggctctgcacagaacatctatactgtatgattgttcactttatctcgtgcagctgtttgctagagaaccataaagaagggttttgaaaacattttttttttgagatggagtttcactctgtcacccaggctggagtgaagtggcacgatgtcggttcactgcaacctctgccccccgggttcaagcgattctcttgcctcagcctcccaggtagctggggttacaggcgtttgacaccacgccaggctaatttttttatttttagtagagatggggtttcgccatgttggccaggctggtcttgaactcctgacctcaggtgatccgcccgccttggcctccgaaagtgctagaattacaggtgtgaggcaccacacccggccagaaaagcctcttttaagatatcaagagttggatatatggttacaactacgaacagaaaaaaattatacagatatttttaaatggaaggtaatccatccacattcttttcttgcattggaaaaaatggcagctctctgaaaaataatatagcacatgccttgtgagatggctaacagtaataaagaaaggaaccctggaaatggggatgaaaagagatgcacagaagtggaatagtcaagagaaagctgcttcagaattaatagataatccaaaataggaattatcaacatgcacataatagagattcaagtattaatatggtttagtttaggttacattcttggtttattctaagagttatgaactactgtttgctgctggtttttctccccttctgaaggattttattgttgtctcattttgttttgttttatttgccattttgctgtttgggatcacttctagtctatattaatcaggtttaaaaagttgaactgattttgctgttatcatataaagcttctaatgggagacattgttaatacagatagaatatctggaatttttctgattccaactttcttttaactcatttttagtttattgtttatattctgcttatttggcaaattttcatgatttaaaatttttcttagttaaaaattgtttgtaatcactagttctatttgtagcttcagtgcactgcataaattttatgcaatacaatacaggtaatggaaactctgaagtcatttagttgctccagccacacaccaattagctcatgttgtttttgctgttggtccattccagaaaatggtaaatatacaggaacatacagaggataacaaatattcatgtttctgatacatctcaaattgcacgtgtccaaaactgtacccttgatctccccaaagctgttctacttgcagccttcccaatcacagctgatgacatctccatccttccagttgctcaggccaaaagccttgcagtcctccttaatacatctttctttcactccacatacaattcatgagcaaatgcaatggcctttattttcagaatgcatcctaactttttcctaatccattttctttcacctgggtcactgcagtagcctcctacctgggctccctgcttctgcccttgctccctacagtgttcttcacactgcagccagagtgattggcttacagtttaagtcaaatcaagcaacttcattgcaattgcccccacttctcccagagcaaaagccaagatcctccatgcttcctctctgcttccatctcctgacactcctgccttgcttagttctttctaggcacagggctactcggtatatattcttgaagtaaggcaggaacaacccatgtttgtattaaaggacattgaggttgtctccccggttcacttttcaactcactttaatgtgacttctatccccactgttccactaaactgctaacgtaaaggtctctaatgactttcatgtgactgaatctaatagctacttctctgtccttgtcttacttagtccttctgtcttatcactcaactagcacatattctaattctaggaatatggcaataattaaaagaaacaaaaacccatgtccctgtgggatgtacattctagtggagggaagaaataaataaggtgacaagtgccatggagaaatttgcagcagggaagaagaattaagagtattggagtaggtttccattttaaataggctggtcagtgggaactctattgaaaaggtgactcagtcttgagtagaattttttttttttttgagacagagtcttgctctgttgcccaggctggagtgcagtggcacaatctcgactcactgcaagctccgccccttgggttcacgccattctcctgcctcagcctcccgagtagctgggactacaggcacctgccaccacgcctggctaattttttaatatttttagtagagatggggtttcaccgtgttagccaggatggtctcaatctcctgacctcgtgatctgcctgcctcggcctcccaaagtgctgggattacaggtgtaagccactgtgcctggccttgagtagaaattttaaagagtagaaggagcaagtcaagtggaagagcattccaggagagggaataatcagtgcaaacaccttgaagtaagagtgtgctgagagaaagaatggatgaaatcaactaggggtgagtggagaatgagcccaagggtcgtctgtcactggggcaaggaaatgagaaggaacctgcaaaagaggtggaaaaggagtggccagtgagagaggaggaaacactctcccttcctagagttagaaacaccattttctcttagttttcctcctacctcatatctcttttgagtcctgtttgtggacttctctatacatcctctataataatatactgtatgtgccagttagtttccagaagaggattcgagtataatatgatactaggtgtgcatgcatgttagaactatgagtgaacccaagcccagaaaaaatagacttagtaagaatttaaggtagaaggagtagaactgagatactccacaggtcagggtccaagtaccaaaggagtgtggtagattccaggttaggcatcagtaaccaaagtccatttattagtataacagggcttgaggcaaaagtatgggttgcagaaaaaactatgaagggctacgtaaaaagccaggctatttcagattctttccaaacaatggtgaacagaacagggcccatttcccagggagagaagctgacaggaatcgggtaaaaagtagaccctagcattgacttgactacagaatgagaatcccactcctcaggcatgaataactatggacccaggtggactgaaggaggtatattcacctaggtttcctaaaaggactaggtgctcagtctagtcaccacatggggctattccagggtgtactatctgatagcatcacagaagtagaccaagatcttcatcctcaggcaagagcaatttcaaggatttctaggcagcactggtttgtaaggcaagaggtcttggtaccttgctcacttaggccctttgtttgatactgcagaagtggcatccctgcacactgaagatagctaggaactgcttccaaattgctggcatggggctgagacaggaggaaggactggaaaacttaaatgttactatcaactaaaattcttttaacttcattttcacttctcatccattctatatatatgtgggtatttttttaagatccaagtgctagactctgttaaccttcctcttattcagttgggaccctatctctagtctgtcgagaaaattaatgtttctgattatatttaatatattcattatcctttccaatgtgtatgttattcacatgctcagtgaacatgtcctctacaacattttcattgatagatgaagatgaacaagaagatcaagaacataaccctgtagtgtatcaccagaaacctctcagcaggtcaacatattaacccttagcctttggttatgagtcatttgaacagtttctaatttacccagttgttcttaagtaagcccatatttcctcaatcagtgagggagaagtgagggaaaagatcaagaggaggaagcagtaggcttggtaagccatgccaaggagtttacacactatctacagtcaatgagggtccatttaatggttttaaacagtggagggagatggtcacagtcttatattaatgggtctgtgcaacctccttagtttgttcttcattaattgctattctttcatcttttgaatataatttaaaatctgagctcataaagtaactagaagagtaaaacaaactaaagagatgtcaaagcctttctagttccacctacgtccttgacctgatgtgcttgcgcttccttcactactttcatctggcaaatttctatacatccttcacatttaacctgtagatcgccatatcaaatcatatgttcatactaaagtatttcatgaaagatacatacataccagtatacatttaacatgttccatgtccacctacaaacttcctttctttttcctatgagtattattggccttgagatgttggagttctgtcttgaaaagagtcatttgtaggccttactttgtggctaattcatccctgcttttcaataactattctttaggttttccacactctttggtctgtcacactttatcactagcagccccttcacagatacattttcgtctttttctttgcatctggcatttagcattcctttcaattgatgcttattaaatattaatataatatttactctagggggctacttgttctcatggtactattgtattaggagagcaattaaatactaattaatttttaactgattgttttcttttacaattcataggttccaactccattgggagctccttctctaatggcacctcaacccatgattcatacccagcaaggcctaaggaccagtagtccttccactccatccccagagcatcaggtacgtttgggctgttgttgctaagggccttggcagagataggcagtcactggaggcaggatcagtgttataatggagttttgcaacatagccatcttttgtatactgttggtctctcatagaagaaagcatagttctaacattttcatcatcatagaaagacacagaactgtgcagacctggtgcagacctctataaacttgtgttgttaagcctcaactggcttcttatatttattcagccatccttttattcatttatttgtttattcagtcaacaaacccaactgtgattagtattggagaagtggctaactcagtctggagatttcaaggatgacttaccagagaactgatatttaagtttaataataagatttaaaaatagacagagagttaacagagtgagaaagcgtgctccagataaacacagacacagagagggaagcacaaagcaccatgggaactcaaagaacggaataattaatttagcaaaggaagctttcaagtactgaatgataaagaagatttcaaatagtagatgtatagcggatagaagaagtttggcattacaggcagaaagaataggttgaacaaagaagtggaagtaggcagtggtaatatgagtgagtatagctgaagtgtatgggagagtgtcatgatccaggtgtccattgtctcagagtattgttttctagaagactttacaaggtttcttctttcagtcttcagctgatgtgctgagccccctgatacctgaacatttgttttaggaggagtgacaaagcttcaggtgttagataatgagaaaaatgacgagagttttgtattaaaatatttgtaatttatttcataactacaaataaaaatatgtataaatgattaaatatttacagatctgtctctcattcagacgcagtccaagtagaggtcccaaagcaaaaagattcagattcagaagtgaataaaaagatctttcaacaggctgaactgaatcctccacatcttccaagtaaaataaacgtttacttggaagacattcaatactcttgaaattctttaatttgacgtttggaggttatgtactctatttttcttattttaatggttaataattcacctaacccactctagtcttccaaccacaccccttccctaacaagttcctaaaagcacgtgtgtcagcccggtgcagtggcccaagcttgtaatcccagcactttgggaggttgaggtggcaggaggatgacttgaagccaggagtttggaccagcctgggcaacattgcgaggccccatctctacaaaattacaaaataaagaaattagctggatatagtggcatgcacccatactcctagccactcgggaggctgaggcaagaggactgcttgagcccaggagtttgaggctgcagtgagctatgattgcaccattgcactccagcctgggtgacagagagagaccctgtctctaaaaaaaagcacatatgccatgtgtcatacaggcgcagttctgggccctctgagtgccctcagtagccacagtacaagccttacttcataccaggtgttcttcagttgtttggcccctttagggactgctacagatctagtcatgactctcatctaatccagagccaggtccctaggtaaaatctcaggacttcatcccctgaagactgccatggagtgacaattcgcttccttcctgtcctcatagcaaggctgatggcatcattttgctgaaattgatttcctgagcagactctccagactcccagcatgtaattgctgtagctgctctctaagtaacagcaagagcaatggttgcctatgattccttgtcttgggcagggagtgtgatccctgagtaactaacataaactcaccttgccatgggaaatttcatcaagtattctggtctctgctggcttggctttcttgaaactgtaatgtgcccacacaccgttatttttgagccatcatctgtatcacaaataaacagagactacaatatgtgaaaggtgatgaattttctagagattagcaattccaaaatcctctttaggaagaggaaatggaggccctaagagagatgacttccaaggtttcttggctccaaatccagaattttttccaatgtgtaggcaaaagcaggtcttccatgcaagatggagtcccactacacttagtgtctctggcacttagcattaactgtcttgcccagctaggtggtttttcatgtgagtgtcttagtttcttaactagatttattatctccagttatacactgcatcggattcttctagtgtaatttatcttcactacctcaatgttgagcacattgtacatgctccacaaacatttgttgcttgattcacacagtcaataaataatgatcaagcaataaatattgatcaacttgatcaataaataatgatcagttatcaagctcagtgtgaggcccagagaagcaaaggcaagagaaacaagtccatacccttaagtatttataggctgatagaggcactcgtctcagcttctccttttctttggtactgacatcagacattttagagtcaagttgaaaagagttggtcgtatttttgggctttcatatttcaaggcatttcaacatatccacaaatagcaggcccagtgagctgtgcaatatcatggggctccaatgttttaggagttagtcctgagccagactgaatgctctctcttatctgtatatgtgaagaatagcccttcttcctccccaggaggctgtgagggatttaaaacagatgtctatctgagggaccctgcagatctcccatgctatgagcaggctgtgtgatttctccccatcatgaggccattatcatgacatgttatggctcatgtctcaaacccttgagtttcttattctgtgccatatccatgcctttcaattatcaggacagtagctgaaatttattgagggcttactaggtactgggcacagtatcaagtatgttattatgtgtaattccattcaatctacttaataatatgtgcccaaagccctattattatggttattttacaatggagaaaactgagacagtgttaaagtaactaacctaatatcccatagccaataaataatcaagcttgactgcaaagtgcatgctcttagccttaaccattgtgctggaaatgcaccatctctcccaattattatacaggaaaacttgtgactgggaatttaccatggcttatactgaaggtcttcatgtatcctaaggagtccggcccaaaggagattcaggaacatgaaagcagagtttgaacctttttacatccatgctttttattgggtttggttggaaaggaagagcttgggtggacatgggggcagagggatttggagggtgtaattactcaccttggggcccaagatcaggttttctaaattgagaattgcatagttacagaaggaacccggaggatccagtgggatctagtgacaaccatgggatgcagaattagtactagtgccctgatgactcaccagaggtcgtagtcaaaatgtattagcactagaagtgagtctggagatcctctagtccaaagctcacatttcacatgtgaggacactgagctagataggtgaagacacttgtctaatgaggcacagcctgttaaatgacagggttaaactagaacccaagttctagggcctattacacagtggcaagcctagaaatggattctggaaataaagcagggtaatgtctgggagtccccagggccatcattctggcagatgaggtggtggggtgggggttgcagaagggttagttccctgaacaaaggacctctccacatcaccttggataaataacatcagtcccaggaaaaaggaaatcacattgccacattttaccttgtctaggaaaatcctaccttgtcctctcttgtataaacagagcaaaaacactgaagatacaataacaatacacagtgagaacactaccagcacactcaacaacccagggtagtgagtatggaggcccattggcatgtctggaaatagaatacacatgtattctgacttactaggaaatagccccaagaggctggggtggcttagcatgcaggagcactatcacagttgagtgccctccaggggagttccaaagcccctaggggaaactgcactttctgctctcagaagtcaggattagaaactgaatcagaaggtcgagcagaggctgtctcagaacatcctgaaatgcttggcatctctctgaaggccttgggctctttcccagtgggcttcctgggaggaaatgaccccagtgaccaggctcaggaaaaaggagacacattcccccagcctcaggatttgcagctcttcagagtaatttcagaggcttgtggagattgggacagaacctgttacctgcacaaagcttccaggcaaagatggagtgagagttgttgtcggttcccggctgtacaaatttaagtcaactcttggttatctgggttctggaagttgctaaggatatcaccctcttcttccaggggactccaattgtatgtcacatcattttcttccttctctgcagagcacattagtgtgacatttacaggtactattcactgaagtcattaaactctggcttcccaaaatatgagccagtggtgcaccagagctggcttgtaccagcttgtgagaaccaattgttaaatttctagaaattctgcaagatggttgttaaacacagccatcatttaaaattaaattataaaaatttacaattaaattcttttaaaggcaaaggtaataaatattcaaaatttatcaccttctaattatttttcgacatttgaatgttacctatgctcttgaggttatttacatcgattgtatctgtgtgctactgggcatgtcctcccaactcgacatggattgaaatcagccattgtgggagtatccaggctacagaaattggtagatgctacaaactacggcttgatctatgtttgtcactctagacttgaaagcaatggagaaaatgttactaatgcagattcagcttaaaagtgagttgtgtctgtagccattattgtgaacagcaccataaaatgaggcaatatttttctggtatttgaaaaccattatccaattcagcaaataaatcactgacattgttgatgaatgatccaagtaccaatataaaaataattgttgaattacttttttcttattacttaacataaatgaaaatatcaagcaacattcatgtcagaactacactagttcatcaattgcaactgtaggttgtctagggagatatgtatttggcaaaaatcaaaagcatcctgtcagaattggttatacagaattaacgataaagagtattgtatattttattatcacttatgaaattgtgtgctatacaccttttacatcaatacaatttataataaatatataccccctttctaaagagaattagttgaacatttatcagcacaacactacgtgaaatgattgtttaagttgttctgtttcctgttgtatgcgtattttctttacattttgttttgttttgtttcaaaagtgtccatggtgaaaaactacaaccttttaaagtctgttttaaaaaatgcttttattaaagcaatctaaagataagctgtaaaaggtgtgggctactgaagggttgctaaagaccaatcatatttagtcaggtaatagctagatttggatctggcaagaggaagtttttttttttttcttttcctttttttttttgctaagagataagaaaatgaccacctatagagttgataaggttagtgtactcttggaaaagctgctgcagccatggcaggaaggaaagaattggtatacaactttctaattaagagaacactagaaaggaaatatattcagcagtataaataagggaatcttctgtttgtacctgtaagggagtaaaacatgagcgataagctgataaggcttttggctccaaaagaaaaacctggcccgaagtgtcaaatactatatctcttagagggatttattccaaattaaaattagtgataatttggagaaatatttcctaaagtttgaagtaagtccttgattggttctaacaatgattaatatagatagggatcagtgaagttgaacaaaatttgcatgtgtatctgatatctcaatgtttttctgtagaaacgttacctacttttcaaaaacaaaatttttttttggaaggcactgaggtgggggagagtggtgaagaatagaattcccatatacttttctctccaggaacagagacattatcttacaaaactgctgaccagaaaaggtcagagtcatggttagctaacatgtcttcatcctcccaagccaaatcgcatagaagccactggagaactagtttggaattccggcttcactactatgtagttgtaggattttggaggagctgtacaggttcactgagctttagtttcctcattcacaatatgacgataccaatttcttcctcatattatatctaaagacatatctatgtctatatgcttgatcgtacattatgtgcggagataaaccggtaacagtgattgcctctgagaagagagacttactttccattgcgtaattcttaggctcatggtagaatttgtgcaagtggatgaagcactgcctcactgggaaacactccagtgaaataaagcacagaaaagagcccgaagaataattacttggttctgtatgacacatgtgcttttaaagggttgtagtgtaggatgacattgggtaagtccatgggcctagaagcctaggtggagttcttaggattttgtatgtagactatgaagttttggaaacgtttgagctggagagaagacattctgatcaaaggtggctttcaggaaaggctggtgcgacaggcagggtatttattagaatgaggccagtgaccactctgaaacagacacaaagtaagttcccttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactgtaataaatatttatagatctctgttttgtgcatgtgccagcattcttctgtaagataaatatttatggaatgccagctagatgccacatactgttttgggtgaaataacatccagtatctgctttcaacaaggacacaggactgggcatggtggctcaaacctgtaattccagcactttgggaggctgaggtgggaggatcacttcagtccaggagttcaagactagcctgggcaacatagggagacccccgtctctacaaataattaaaaaataattaggctgggcccggcggctcgcacctgtaatcccagcactttgggaggctgaggtgggcagattgcctgagctcaggagtttgaaaccaccctgggcaacatggtgaaaccccgtctctactaaaatacaaataaattagccagacgtggtggcatgcgcttgtaatcccagctactcgggaggctgagttgggagaattgcttgagcccgggaggcgaaggttgtagtgagccgagattgtgccactgcactccagcctgggcaacagagtgagactccatctcaaaaataataatagtaataattagctgggtatggtggcatgcatctgtggtcacagctcctctagaggctgaggtgggaggatcgcctgaacccaggacgttgaggctgcagtgagatgtgatcatgcccctgcactccagcctcggcaaaagtgcgagacccagtctaaaaagcaaacaaaccacacaaaaaactagggacacagtttggtggaaattataggtatataaataaaattagcacacaaagtagaacagtagaggtacagggggatggtaactcattactttgtaccaaagcacctcattaacctggaggggccaaggaggttcagaggaagcttctaagaggaacagatagctgtgtagaatttcaaagattagttgtgagtttggaggcagactaaagtgaggaaggggtagtctgggcctaaggcaccatttatgcaaaggtacagaagtttgtaggtatattttctcatttgattttggtgacagttgtacaaagttgaatatgtactgagtattagatgagatgaaaagtcattgacatggaaagatggagagtgttaatggacagaagcaagatagaaaacattaagaacagtgtgctctcgttttggaaaaaaatgtatgtatgcacaggaatatctggagaaatccacactaaaggcatattaacagtggtaatctctgggtagttagaatatggcatttttcttgtttttgcttagctgttttcttaattttttacaatgtacatgtactgcttttgtgatagtaaaagtttatttgaaaaagaaaaataaagccattggatttgagatcacctacagggaggttacagatagagaagaaaatgtgccttggggcggggtgcagtggttcatgcctgtaatcccagcactttgggaggccaaggtgggcggatcgcttgagcccaggagttcaagaccagtgtgggcaacgtggcaaaaccctatatctacaaaaattagctaggtgttgtggtgcatgcctgtagttccagctactagggaagctgaggtgagagtattgcttaagccagggaggttgaggctgcagtcagctgtgagtgtgccactgcactccagcctgggcaacagagtgatgataccccgtctcaagaaagaaaaaaaggaaaagaaaatgggccttgggaccaagtcctgggagagggggaaatttgcgtatcaaacttaaattgctcttctaactagtaaattaatgatagacaaaaacaaaaaaaagaaaaaagttatattgctaactctacaactgtggtatgtagcaggatactcactctagcttaacatatggtctaggcctaaatgtggggagaaggggtaaaaattcaaagcacttaggaaacatcagtgaacgttggtgttctggatgagaacagtgtttgtctagtgttttaaaagagaatggtagagttggagatagtgagttaggaaaattttcttgagttttacctattttaatagtgggttggtcatttttttgagacaggctttctctctgttgcccaggccagagtgcggtggtgtgatcacagctcactgcagccttgacctcctgggttcaagcaattcttccatctcagcctcccaagtagttggagggctacttttctctttttatttttctggaatttctctcactcctatgatgtcagctatgcaacaaaactatttttgtgtcatgatctagttgttttgcagcagatggctctatgtagtttacatgctagcctttttgttttttttttttttcaatttgctattattttatttaggatttttgaatttctgttcataagtgagttcagcctatttctttctttttttttttaatttttttagtattgatcattcttgggtgtttctcggagagggggatttggcagggtcataggacaatagtggagggaaggtcagcaggtaaacatgtgaacaaaggtctctggttttcctaggcagagggccctgccgccttccgcagtgtttgtgtccctgggtacttgagattagggagtggtgatgactcttaacgagcatgctgccttcaagcatgtgtttaacaaagcacatcttgcaccgcccttaatccatttaaccctgagtggacacagcacatgtttcagagagcatggggttgggggtaaggttatagattaacagcatcccaaggcagaagaatttttcctagtacagaacaaaatggagtctcccatgtccacctctttccacacagacacagcaacaatctgatctctccttcctttccccacatttcccccttctctattcgacaaaacctccatcgtcatcatggcccgttctcaacgagctgttgggtacacctcccagacggggtggcggccgggcagaggggctcctcacttcccagacggggcggccgggcagaggcacccccccacctcccggacggggcggctggccgggcgggggctgccccccacctgccggacggggcggctgccaggcggaggggctcctcacttctcagatggggcggctgccgggcggaggggctcctcacctctcagacggggtggctggtcagagacgctcctcacctcccagacggggtggcggcggggcagaggtgctcttcacatctcagacggggtggctgggcagaggcgctccccacatctcagaggatgggcggccgggcagagacgctcctcacttcctagacgggatgacggcctggaagaggcgctcctcacttcccagagtgggcggccgggcagaggggctcctcacatcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggccgaggctggcagatcactcgcggtcaggagctggagaccagcccggccaacacagcgaaaccctgtctccaccaaaaaaatacgaaaaccagtcaggcgtggtggcgcgtgcctgcaatcccaggcactcggcaggctgaggcaggagaatcagtcagggaggttgcagtgagtcgagatggcggcagtacagtccagcctcggctcggcatcagagggagaccatgcaaagagggcgagggcgagggtgagggtgaggctagcctttttctttgtatgtgttgtaaatcttgcagcctgtcatttaactttacccttcaagctgtgtaaaagttccttagtatttcatgtgttaatctctttttcgacacttgaatctgagatcttttatctttctttaattggaaattttgtgattatcactttttctatcgtctgttaattttttttcctctttctttctgggattcctgtttacagatgttgacacttctaattctgccttccatttatttatattatttcccttttttctgtctttgtcatttatcttttggcaattagatggatagccatgagttctttgtttcagctgttaagatttttatagctggtagttctggttggttcctcttcatattaccaatatcctttcttttctctttgtggtatctttaagtatttaatgtatagttttatcttttggtatttgttaattttgtttcatatggtagaggttgttgaatttattgtctttatttattataatgatcaaattataatgtcttttccctgtcagcttagattccctcagggatatcagctactttggccagtaatgtacgtggaggtgggggtaatttaagtcactcctggtgggtagcagtggcgctacctcggctcactgcaacctccacctcctggattcaagggatcctcccgcctcaacttcccaagtagctgggattacaagcatgcaccaccacgcccagctaatttttttgtatttttttttagtagagactgagtttcaccatgctggccaggccggtctcgaactcctggcctcaggtgatccacccgcttcggcctcccaaagtgctgggattacaggcgtgaatcactgtgcccagccaagctactttctcttcaggtgaagcagggtagggaggagtgtattgcttgggcatgtgctgtgtcattggtggtctggttcctaagttagctagggctgcatctgattgattcattaatatgctttatagcatattacatataatatttatatatacagaatgcatcttaaaagtcatttacatgacaaaaaatcttgatctgaacatactccttatgttgtgtgtgtatcacatattttacaaatgtataacatctttctgtttacctatatgaacatatcatgcaaaaataagcaaacttgagcaatctatggcatccagattgaattgtagtgaaaaaatgaatgctaggtgtttctagattattcactggactgtattatcaaatgatgacactatgtttttttcttaagcagcaggctcatttaacacatttcttgccaggtcagtagcacagggtgtagtaaatttgccctgccaacctgctgcacacatggagtgacttcttttatgtgacgcaataagttcattttcattgttgtgtttatattttgtttacattttggtctctaataatatttagtaaatttacctcgaaagaaccagagcttcgtttttatatccttagtctgttttgctagaaattacatttgacagagaccctagaactgttttgcatatatctccatgcaaaacacatgcatctaattaccataaagagctaaaccccagtgacaaaaacggtatcattgttttctctctttaattgactgaatgtttttagcatactgtttttctcttatgttcttgtcagtgaggttgattgcatttgggagtcacttactagcattttgctagtagctatcatataacttatccattaagtcggatcagttgtatcatgtccatcattgtttttttaaatttcttgtgtttaaatcagtgatccatttataattttaagaacgatcgttacctcatttgaaaagaagagcatttatcaacataaaagttaaggaagaaatacccaaagcttaaaagaatcactaaattatactgtatcataatgtggtgtgtttggcattcagatgattctgtacatttttcacagtgtgacaagtgcacatactgagaaggtgtcactgtgctttgcctggcatttagctgactgtgatgtacatgtgtgtatacccaatgcacacaccaggagtagctatgtgcatcactggataggggattggtgtcttctattttagaatgtaacttttgaatccatgttatttttaaaattagttttaaaattaatctatttaaaatttcattctaatcaaatgcagaacctatgaatcacctctgtggaatatagtctgctctagaaatgttaaatagccatggggtatttgacataatagaacagagctttgtcttcatggaatgggcattccataaacattcactagtatatcttaaatatttttattaagtatttatactttaaatattttatgaatattttactaaatatattttcttttggtgaatatttctttaaatattttatttttataaatatttatatcttattttatctcatatctaaaaatatcttaagtattttatatctataaatagtcctcaagaacacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagattgtgtgtatgcttatgattttgcttgactggtagaataactatttctagtacattttaatatgtggtgaactttgtaagacttcagcaactgattgattgggcatgaagcaccaatgaaataatagaagaatggctaattcttacaataatgccttctctgtatgtcaggcactcgggggtgtgtgtgtgtctgtgtatactcagtgcttaccactgacttcataggtgtagggactgttgtaatcctcattttacagatgaagaacctgagatatagaagttaagtgagatgccagatttgtacagctagtgagtagctgagccagagtccatacccagccacctgggtctagcattcatttcttttaccactacacttagcctgcatgatggtactgttttaaatgtcctaggttcaactgtgcaatctctcctttataaccttggtatcaaactggcctgtttatggtactgtcattttttttttttgttttgaaggagtccaccaactcaatggagaccagattcttgctggcagataacctgtattgcaaagcttcagttcctcctaccgataaaatgtgtctgtggttgggggtaagtaaatgttatagccacagctgatatatttgtaaaccagtgtgttttctgtagcaaacacactggttttgctagtatttgctagtattttagtagtattgctcgagatatgtaaagtgttcatctccttttgattgtggaagggacaaagggacagagtccaagtggttcatattagaaattgactagaatcagaagtgcgatgaagatcgcagtaaaaacatactgaagtctctcccaatcaagataaaactgatcaaacaaaccctgcttctcttccagttagtgctttatctctcttaaatataatggaggaagagcaatagaagtaaaatagaaggtactgctgaactttagataaacgcttcttcccataagagtttaataattctagaaagatccctctcaatttaaggggaaaaagagtattgcaaaaagtttgaggttagagtttattttttaaaaccatgtatttcagttttagatgatttcattgagcttatctgtgatttacctattttgctcttctcagtcctctgactatccagctacctgtctgtggatcttgttacctcaggcaagttctcatacaaagtagcaagccaagtgtacttctaccagctgtcctacggggaggatttcccctagctgctgtcctgtaggatcactctggagaggcactctagattagcccaaggaggtttgctcaaagtttgtacaacatttatatttcactctacaatctgcatttcagtatttatcttttataatttatcactaaggctttttaaaaaataactttgaagcatagcaactacacctgagtgtccaaggattcaatgattttctgtattcagtttttttgtagaaattgcatgaccttttgattcacaaattcaagtgttactttatttcaggaaagataatttctgttgtgtacttgaatgtgacttttgccccatttcttttattatcttttgggaataataaatatgcatatgttcgatctcctttatctgttttcagtacctatcatgttctctgttttcagttattcgatgtgtttcattctgtgtgatttcctctggctgcttccccatgactttgtgttttccctggtagttattctgttttgttgcttttactctgtctttcgtaactgttcttctgtttctctttctcttcattttctttgctgagctcttcttgctcttttcatgtttttcttctttcattcctcttgaatgtttaaatcctcatttcaccactcatagactggcacttcccacaatcttctccatctcagtaaatggcagaatcttttgcctggttgctcagaacaaaaatctttgagtcttctttgactcttctttattttatatctctcaaccagtccttcagcaaaccccactggttccttcttctgaatagattgagaagccaactatctctcacttccttactgctgttaccatggtccaggccacctttgtctcttgccaggactgtgggaatactgtctattagtttttagggatgccataataaaattaccacaaactgggtggctttaacaactgaaatggactgtctcatggttctggaggccagaagtccgtgatgagccccagaatcagggtcgattccttctgagagctgtgagggaaaatctgttctagcctcctctcttagctttggtgttcgcggacagtctttggcatgttgatgtgtagaagcatcactgtgatctccgccttcatcttcacatgtgtgcatgcatgtgtccaaatttctccttttgaaagaccttatctccaaataaagtcacattctgagctactgggggttagtagtccaacttattttttgttggggagacagaattcaatccataataccttacttccacgtaaggtcacattcgctagtataaggggttaaaacttaaatgtatcttttttggggacactgtttaacccataataataccctaattcactgtcttgcttctgcccttgctggaattcctaaagtctttccagcacagtggtcagattaatcctttgaaatctcaatcaggtcattccattattctgcccaaaatctttgaatggtttcttatcacattccgaggaaaagtccaagttctttgagtggctgacaagttcctatacatcctggtactctctgttacttctctctttttttttttttctgagacagagtctcactctgttgcccaggctggagtacagtgttgtgatctcagctcactgcaacctctgtctcccgggctcaagcgattcttgtgcctcagcttcctgaatagctgggatcacaggcacgtgctaccatgcccagctaaattttttggtagagacggggttttgccattttggccaggttgatctcgaactcctggcctcgggtgatctgcccaccttggcctcccaaagtgctgggattacaggtatgagccaccgtgtccagtctctctgttcttctcttacttcctcgcttggccacacttggacttcttgccagacttagagcatgctgggaatggccctgcctcagaacctttattctagctctttcttctgcttaagctgccagagtagtgcttttaaaacatgtcagatgattccgcttttctgctcaagaccccagtggtttccctgtcaccaagggtggaatacagaggtgtcctttccacaggacagccctactccctctcagcactcatttatgctcattcttttgctcactctgctgtagccatggtggccccctaactgttcctggaacctgccagtgtggccccacatttctacttctgtgttcttcacactcaatcctttgagttctcagttccgattgttagctcccccagggacctgctatgacttgtctgtcagcatttcttggtttcacttgtactgtttatcttgtattgttttccttcaaagtacttagcactccctgatatgttattgattggtgtatttaccagttccctgacacataataagtgctcagtaaaaatttttcttgggtgaatgacatttttgttagtttttcatcagagttcatacatgctaatggttcaaagagcaaatagaaagcagcaggctactgctccatccccagatgcacccacttttaatcatgtctgtatatctgtatgtacctaaatatttggaattttgttaattgtttttacaaaaatgggatatatattgtatattgttcagcacagatgtctttatttgtgagtagacacagagtttgcctccttggttttattggcttactattctgtggtagggctatgtgataatattcccaagtcaaggggtgtttggattgttttaaaatttcttgtacagtgagcggtgctgtagtaaatatttttgcacgtatagacttgtatacaaaggcatatttttgtatgctgctttgaaatggaattgttgtgtctaagagtatgcacatttaacatgttgatggatactatcaaattgctctccagaaaagactaccaattttcattttctccaaccgtatataaaaatacccttttattaacagtctcacccacatttttagatttttgctagttttataggtgaaaatagtatcatcttataggtttttgtatgacaaaatgctcatttgtatttcctcttctgtttcccttcctgattatgttgttgctccatttttctgttggattctttttctttttttttttgatagacatttaggtcttctttatatattatgtatttcggatgcacagtcttctcttaatattgcagatactttttctcatctgtcacttgtcttttgtggtagctcttagaagttttaaattttaatgtaatcgactttatcagatatttataattttatcttaacagtgtactcctttcaccaaatctgcaaacatttttttcctaatatttatatacttaaattttttagaaaacttttttgttaaggataacatggaaagataagcaactcctcaggataatgggtgagtgacttccaaaaagagggcctcccaatggccagtaaacatatgaaaagttgtcccacttcattagtaaacagggaaatgcaaattaaaagcacaatgtgatctcactgtgtacccaccggaatggtagggtgatactaagtgatggtaggacatggaatagtgagaacactgatttactgttggtgaaggtgtaaatggacacagccactggggaaactggcagtatctgttaaagcagaacatatgcattgcctatgccatagcagttccatgcctgtctctatctctttctgcctcttgctgtatataagaaatgtataaatattaactaaaagaaaggtataagaatgttcatatcaactctgtagtaaccaaaacctggaaacaacccaaatgttcatcatagtcgaatggatgagtaaatcatgatgtgttcagactgtggaatactatacagtacagaggaggaatgaactgctgctacacgccagcactgcaagggtgattttcacaaacaaggttgagtgaaagaaactgcatagcaaattaccacaaactcagaggcttaaaacaatatccattatctcctagctgtataggtcagaaatccagatgggcttggctgggtcctctgtgcagggtcccacaaagccagaattaaattgtcaacagggctgtattccttactagcatctctgggggagaattagatttcagccttattcacgttattggcaaaatccggttctctgtggttgaggtccctgtttccttgctgcctgtcgtccaggagtcagtctcagcttctagaggccacctgcaatccttggctcatggtcctttctgttttcaaagcagtgatatgactagtctttcttacactttagatctttcaaacttctcattctgctgccagccagaaaaagttctctgctcttaagggctcatataactagattaggcctacctaggcagtctgtatattaaggtcagctctgacaaatgatgtaaatatctcatcagagtcacagattccagagattagaatgagacagctgttatgggagccataattcttgcctactatagaagtcagtcacaaaagagcacatatactgtgtcattctgtttatgtaaagttgtaatacaggcaaaactatgctgtaagtcaggttaatggttacctttgcggtgggggtgctggtggtaactgaaaatgttcacaaggaagctttggggtgttggtgataacctgtccttgatctggatgctggttccatgagtgtgttaagtttgtgaaaatacatcaagctatatatttatgatatgaatacttttctatatgtatataatattaaatataaacaaaaaaatcagaaaactgcataaagcaaagtgtaagtgaacgaatctgttgtcagggttcaaccggagaaatagaaccagtaggatatagctaacctgcataaacttgtgtgcaaaggttcaggttaatatgtgtgtacctcatggtttcatactgttacctccaattcaaattcaggacaacagagttttcactttagttgttcctctgttttttttttttttttttttttttttttgagacagagtcttgttctgtcgcccgggctggagcgcagtgacgtgatcttgggtcactgcaacttccgcctcctgggttcaagtgattctcctccttcagcctcctgagtagctgggattacaggcacgtgccaccacgcccagctaatttttgtatttttagtagagacggggtttcgccatgttggctaggctggccttgaactcctgacctcaagtgatccactcatctcagcctgccaagtgctgggattacaggtgtgagccaccgcgcctggcccccctgtttcttctatatcaagaatcctggttttcagaaataccaagggtgatagaattaagctagacaacattactattcacacgcaaagcattcttagaataacaccacccaacactgttaccactgacatttttgcatatgttcttcctgtccttacacattctttataaggttgttcccacattgttggagcacagagccattatatactgtttgctctctctctttctctctctcatctttcatttatcctagttcttcgtgtaaatattgaatgcacatcatagtctttatgttgatgtccccccagtcatcatccagtcattttgattgtatgttactcattcgtctgataagtagattgccttaagatttatgggaatgatattccctgagttatctcatgttgctgacaacttgtctgtggcctttgtacttgaaattcagttttgctggatataatatcttaaactcacattttatttccttgagcatcttatacagtgccccattttcttttgttgtaaagcatcactgtcaaaaagtgtgagggcaaactgatttctttcttctatgagtgatgtgttctttttgcctggatgctcaaaggacttttgggtcagtttcccccaggtatacaaagtaccctttcatttcattttgcgtgtcatttcacccagtgtgtgtgtgtgtatgtgtgtgtgtgtgtgtgtgtgtgtgtgtagtatgtgcatgtgtcacatttcaggaacattttgttgaaatgaaggatttagaaatttttttggtcccctgctttggtttttttttctttgtggattcttgttatatttatgttcagtctttgcttatgttgaatatttttgtcctatctgaattttaatacagttttctaattatggattggattatttggtcaataagtatttatttggcatttactttgtgccaaatactttcatgttgtcttgtttaatccttacaacaatcctttgagtaattttaaaattgcatttgtgagatgaggaaagtggtttaggaaatgccagtggtaagtcaggtgatagggagagttcaaagctgtaaaaggtgtggcttcccaattccagggtacatgcatccctgaatgttggcagtaacactagatcttcagaatgacagacacattaccttgtcttaatccctaacatctgtcagaagtagtaggaagggacaggtaaaagctagctgtcttttttacctggtcaaatatagatgataataaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcagtatcctttcttaaaacaaaaagcaagggaaaaaaggagaaagatttttttaaaaaaacattctttcatgggcagagggagagcattaggaaaaatagctgatgcatgctgggcttaatacctaggtgatgggttgataggtgcagcaaaccaccatggcacacgtttacctttgtaacaaacctgcacatcctgcacatgtaccctagaactaaaaaaaaattagaatacaaaaaacctcccacattctttcttacattgctttagtgggaagaatttccttattaggctaatataaaggttatagattttataagataataaataagatattcggaactagtacttaaataagtttgtagatagattagtgattttgaaatgtgatgtggaaacagcaaattcacataggtgagtaagtatttttcttccaaatattttcccaagacaactttataactggttaaatagtttaatttcacaagcatttaagggtctcctatgttcctgcaactgtgctaagacatatggggcatgaaaatcaattttagaaaagagtggcagtgcctttctctggtagaactgtacatgtaaaacagctgaatgataattcatagcaaactataagtaagttaacatatgcaacaccaaggcaatttaaactttgggaaagatagatgtaggctggacttagttcaaagaaggctttgttgagaagataaaagttaggctgcttttttaaaggcggcgtagggtttaaagatcagcagagagaagaggtgggagtggggtattctggtcaagggggaaggcaagctctttgcctttcttctctggcctgtcttttcctcctacttcctgtcacagtcactcaagacaaaatcacgggagtcacctttcacacttctctcttcctcactaccaataataaatcaatcgccagattcacatcaaatttccctcataaatctctctgcccattactgttctcgttctggggctccaaaacctgcactcagaacctttttaggttcctctcattccatctgtccttcccactatctctagtatgaatttactaggtcactcatttttattcctctggttacaatatttcaacggttccttgttacttacaagatatacatataggcactcttgtgaagtgcccccagcttgtctcacctcatgccactgacctcttcttgcctttccccagtgcattccaggttccagataaccccagtcagttattgtacacactccccaattgtgccacaccctttgcatttctacactttgttcctcctaactggaatgactttcccatatttacaggatgtgctctttttttacccttttaccctaaatatctcagtccaagcatcagagctttcctgaacattttctgatcctcagagtgtttcttgtgtgcttgcttaacacatactgcttagttttaccttgccaaaccgtgagctcttcagatgtaggagctgcactttctcttcttttccagtgtgcagcatgtggcagttgtttatggttggctgagggaaggcaggcctgttggggcctagtgcagtggtcatcatcatctgacgggtagtgtggaaacttcatccagctatgagatgacgagggcctaggacgggtggcttgtggaaaggaaaagatattaaacgtgtgagaaaaaaacaggatccagtgacttagatgggtacaggagccaaaagtgaggaaatcctctaagatgagtcctacaagcttagttaaatgccatttgttattgctagtactgcaaaaggtaggaaaggaaggtgtgcagacaagtgagggagctagggtggacagtctctgttacattgacattctactggagtctaagctccacgaggaaaagaacttcacctgtcttattcaggtcagggctttgtacagtgcctagtcaaaaatacagtagatgcttaataaacttgttaagccaaagggagggtaagagataaaattattgataattgtaataatataaatattacatggcaggatatgggttgagtgatctttcagatttcttggatgagggactgtctttaaaactatcgagagtgtctagtacatatttgttaaatatatcatagttgactagctgacagttgactaataccatagtaaacaatgggttaacaattaatttgagtccttagttttgatagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactctttgtcttactatgtttgggctgctataacagaataccacagagtggggggcttataaacagcagaaatttatctctcccagttctggaggctgggaagtccaagatcaaggtgctggcagatttggtgtctggtaagggctgtgtcctggttcgtaaacggcaccttttcactgtgccctcatgtggcagaaggggcaaggagctcccttgggcctctttaatttggcactaatctcatcatgagggctctgcccttatgacctactcacctcccaaaagccccacctcctaataccatcaccttgggggttaagattttaacataacaattttggggtgacacaaagattcagacaataacacctttttaaagttaacatgggtcttttcacgtatttgtaaagtttacttgtacatatactagcatgttccaagaacaacttatatttctagaaacaccataaaatccctgtggaaggaatacagatctgcaaacaattgagaagttcattgaaaagataacagaatttccttgattgaatttttctttcataattttaaattctcatattttagaatttgaggtttgtaaacatcttgagatattgtatgtgctcattttccccaaactttgttatggtaagtatatattggtatgaaatgttcctgttaatgttagaacaggaatggtttgctccgaagatcttcattttgtctttgaaagtataaatatggatttttaggtaattacaaggactatgaagaaacaaaactctttcgagatatgaattacaggccaaaaattaaggtaattatttaacatatttaaaaacacccattatgggtcaggaactgtgttaggctctgttaattaaataaagatatttaaatcttacctctgccagataatttctgttagagtggtttacattttcagaataacataaccatcctgatttgacatattttgaagtttaatattagtatagcgtactaggagaggatatgggcaaaagattgactacagaacttgatgctgagaaatgtgttggaaatgcaacttaaattgaactgcttttcattataaaatggatgttcagttaagaaaatttagaaaacaggaaaaaaagatgttctatttgcagtcccccttgatatttctgtgtattctgtttctttttctgtgcataggttttttgaaaacatagctgaaatgattttgtcttaatcctactttcttcacttagcatgaaatttgtgggttgtttttaaaactttttctctattgtaagtagagaactgagcagtttatgtttacataagactttttcttatatttagggttttttctgagactagattaccagtggaattatggagtcaatgatcatagtatatcattacctggggttaactgaaagtattgtttagttagatagaacttgtttgacacagaggctgtgaggctgatgagttttcgaacaggtatgttgagaattgagtgaagcatcaacaggcaaaaacttaagaaattgtttttgttctcaccttaaaagcccagaatcataggtgtttgtttgcaggttttacaatttaaaacacacaagccaaattggtgttttcttttttccagctgttattaatgtaacatttttctaaattcgtgtttttcctgtacttcaattgtgctttccatcatcccctgctccccctacccatcctcttcaatataaagacactgacatctgtagggagaagcaccttattcaaggccatacagcggctatgtgcacagccagaatgacagccacatttccttgcttctgggaaaatttacccctctataccatgatactttgctcctttacttagtaatagctaagtttggggaaaatgttaaggtccattttttaatgagtgaacactctgcctttatatatttgctattcacagccttaaacttcagtgatgtctttaaagatcttaaaccattttttgaaggtttgccttcattggttctaatcccatactcttgtgatagtcatggctatgacaatttggtgccaatgtgggatggggttgcctctgaagacactccagagtgctagggcagcgcccgtcacagctggtgttgggttcaactacacaaactcccacaacatggaaaggcctcctctgttaccagtttgctctgaaggacattggacaggcaagacagcatgccagagggtggctttaggcagagttctatgagaattatcttggcagtccccacagactgcacaaaaggacataggagtcaccttggctttagaagccataagggaccaccctctttttaacagttccctgtgcatgtagcatccttgggttccggctagggacaaagcccaggaacaagttgtacactgcgctcttggagcccaagctgtgactcttagcaggtatttacattcatttgcagctctcctagcttggacacaggatacttcgctgagcgttttaccagaagcagtctctcgtcacacagctggtggtctcccttcgtcaggtttccaggggaaccaagctagaaagctatccaacgtcagtgccaaatcttaaaagagaaagggatttgaaacacctcactcataacctgttgaatcttgcataatcatggcccagtttttgtcattggcctgcttcccttttcagttccttttgtaaggcctcttagctaataactgcagaaaatgtagtaatattgtcttcagtaaattttaagggtcagatggaaacatttctgtctgggttaggtgaaagacaatcagccaggaggtccaagtagttaatctccaaagttccttaataaatggatctgaaaacgtttttctcaactcaaaaccaagtgatgttataaatttagtgaacctatgaagtcattgcagagtgcaagcttttaaggcttgtagcccaaactaggcaataactaaaagtttcattttcacactttttattttgaaattttgtaactatgaccagtgtcatcgttaggcctgctaattaaccatatttcctatatattcatactcttttctgtactcagggagaactgcttgtatgaccagttgtgagaaggtaccagtttgagattggaagtgtccaaggctggagaaattgattcacgtattatgtgcacagagttgcttttcttgtttggttaggagaagatggcccaggatctcatctgcacatgaaaattcatatggattatgccctaaagttcaactagagaatatacttgtgtttgtgttcctctcttgtctgatgtcagatttagctgtagtcacgtcaaaaaggatagacctggtgtgcacagtatttttgagcagtttataaaggatcatgcctcttgattatggttttcaaataattttatgtgttagttgattgtgtgacaactctatttgccttctgtggatatttgatatacaggtaggcaatgaccaaataggattttttttccagattttccaagtacacccatcttagactgaatcagtttattttccctagatcaaagctgtggattctagagtaaaagtaaaaaatttaaaggtaaaaggtcagtggataacaatctcttgcatttgtctatttttgcttgtattacctgtgcttttagagtcatatcccaaaaaatcattgcccaggtgaatgttatcaagctttttccctatgttttcttccagtagtttttacaggttcagaccctatgattaagtctaatccattttgagttgattatcatatatggaatgagataggggtccaatatcattcttctgtatgtgaatatccagttccccaagcatcattaattgaagagcgtttcctttccccattttgtgttcttggcatctttattgaaaatgagttagctgtaatgtgtagatttacttctgggctctattctgttctattggtctatgtgtctgttttacaccagtaccatgatgttttgattactgtagctttgtagttgattttgaaatcagagagtgtgattttatgaattttaggattgttttctatttctgtgcaaaatgtcattggaattttgatagggattgtattgattctgtggattgctttgggaagtatgaacagtttgacagttttaattattcaatccatgcccatgccgtatctattcatttacttgtgtcttcttcaatttctttcattggtattttacagttttcagtgtatagacttttactttcttggttcagtttatttccaagtactttttggctattgtaaatgtgattgttttcttgatatctttttcagatagttcattgttagcatatagaaatagtactgatttttgtatgttgactttgtatcctgcaactttcctgaacttatttattagttctaacagtttttggtgggatctttacagtttcaatatgtaagatcatgtcatctgtaaacagagacagtttaacttcttcctttctgatttggatgccttttatttcttttactttactaattgctttatctagcacgtctgccacattgtttgtgtcttctctgatttctttcatcagtgttttgtagttctccttgtagagatctttcactgccttggttaaatgtattcctaggtatttaaattctaatttcataaaaaattagatttttaactaattttcaactttactatagcaactggttgcaataccagagtaaaatggcaatgctggctttgtgtgtgtgtgtgtgtgtgtgtgtgtcacactcagtgtgtcacactgagacactgataccagtgatgcattaaaaagtatggtgcacagacgtcaccactatgcaatatatttatgtaacaaacctgcacatgtaccctctgaacctttaaaaagagaaagaaaaagtggactgtagttgcctttttcttctccacttggtcctcagccaccagatcccaaagtgattctgggagaaatccaggtaattagcaactatagggaaatctgattactcatactaatgaccaaggaaagggtcattaccctggttatctgagagatgaccatggtctaggactttctcttttaacttttctggctagagtttgtgcaggtcagatgataggggaagaaggtccagagaaaataaattttatcctagggaaggagtggacaagtcccaaaacaaagatgactctggaagacaaaaggcaagcagagatgggaatctggccctgaaaatagaggcaggaaagctggaaactaaggactgatccccttcccttcttctctggtccctaccacaccctcctccttatgtatccaatggcccatctctctacgccagcccctaacctccacctgtcccatttctccttggtgaaaagttagttacatcaggaacttttgaaagtagatggggcccaaattggttctgggagaaatctagtaactgtagggaaaacggattactgatactaatgaccaaggaaaggatcatttaaaaagctgataataagaatacaccttcaaagagttttttttaaagggggaggaatatgatcagagtactgggcagctcaaacttttcatgcatgactacatatgtgatgagacaaaattatttagattattactgaataatggcaaatagatatcagtattttagtacttaaaagcggcaggatatactgaaatactgaatgcttatggcaattatcaaccatattaaatattataaacatgatttaatatgacttttattaacctgcccccttcagggaagtctccttccaaccccagaaaatatttctacagaattataattagtatatgtaaagtacttcagagcaacatacatgttaggaaatgttttcaaaacttcaaatgagatggcaattggatattttggaaaatcaagcaatctttgggtcttctattaaagtgtaaatatctgttgcgagctttcattctgttgtgggttccaaagtgtcaggtcacctgagaatttgtggtagaagttcaagttgctgttttcttaaggtaatttttctttttcttttcatatatgtatttgcattggtaaagactaccatttatgacaaagatgaaaccttcgtgaacatgtatctgatgaataacattacgtgaaaatgtataaagtgttagaaatgcaaggaaaatggacagaaacattaataggagtcctaatatattaattgcagtcatttacaggttaattaggcaagactgctagtaatgctaatttaataaatgttagcacctacaaacccaattctcaaaactcatttacaaaaagtgagcacatattaagctaatgaagaaaatgtcaaatttccaaaagtgcaaatagtctgggccacattttctgaccataatgcaggtaaaatcggaatgaataatggtttaaatgagaaaaatatttaacatttcaaaattaagcactatgttaaagaacttcaggtcaaaattataattacaaaattatttagaatttgatgcaatgagaacactaataagcttaagaacaggggattcagattaaaatataagcctttgttgctaaactcaaaagaataaaatacaaatcaagtgaccaacagtaacttttgcttccttcatcattaaaagtaaggataatcagtctcttaggataatactatgtgtcttctgtcttaactctgtcagtatttatgtgactccttctaatagcttggcattctttcctttggtgatcttgtctccccactccttagtcacttattcccatggtcacacctgagaccttgtcattaccaaccactgccgctccttcctaatttcagcctcaagccattctgctccctgaccaccacctcctaccttttcaggttttcactgccctgcacatccttacttctcttcttttgtgtttcattctttgtacatgttgtcaatgttcttgtcatccagctttgctatactgacttggctgagtcactgtcttggttcagaccaactctgtcaattcccaggcagcttaatgtaaccaaagaaaggtcaccactgcaagtctcaagagggcagtgatgctgtgcagtgatccattcattccccttgcaagacagtgtcataccctctctcctggtctcaaaccctgacactccctctctggttgttgctcacagctgatgttcctgctttctagttggccaagaagactgaagtaacgataggactctccatgcactccaccccacatctacccaccatctgcccatattcataagcctttgcttcatcctcctcatcttggcccccagtcttgccctaaccaaagcattgtaaacatttccagggcaatgtatggtatatttgtaacattgcctggctcagcctccagttagaggagttctggcctaggcagtgcacatgttatttcctaagtaccaatgaccttttctgttgagtgctctggccacaaaattatattgattttaagtgatacaccccaaacctatttttcccttaggccttgttactgttagtatattaatttgctagagctgctgttacaaagtatgataaacaataaacagaaatatatcatctcatatttctggagaattgaagtccaaagtcaagtgttggcagagccatgctccctctgaaggctgtatggaaagatttgttccaagcctctctcctagcttctagtagttcttggcttgtggtagcagaactccaattttcacctggtgtttttcctgtgcgcacatttcccctttttataaagacaccagtcattggattggggcccaccttactccagtatgacctcatcttaactaattacatctacaatttgaccgccaccccctcccccaatagaatcacatttacaggtactgagggcaaggacgttgacatctttggaggacacaattcaacttacaacagctgctgtgcaattttgcagaattttaaagttttaggagcgcatgcattgcattatagtacacagcagaacactctgtactttacttctcgtttccattgatgaagtgtccctgcaatcttaaagagaagaaaggttctcccctgcaacttgtctctctcctgaatcctcagtctttctccactgaatctttcttatcttaaaaaacaaaaacaaaaacaaacaaacaaacaaacaaaactctcttggcctgacatcccctcaagctgccatccttacttgtcttcacagaaaattgcttggaagtattctgtactcacttttctttttttccctcctgttctcttctaaccaggtttttctatgctatactccacagaaactgctcttgtcagggtctccagacatgcacattgcgagatccaatggccagtcttcatcttcatcttattagacctatcagcagcatttgacacagttgattgctctctccttttaactctgcctccttggtttctagtatatttgcctggttttcctcccacctccctgcctgctccttctcagtttcatgtaggagttctatcttctatgacctctaaattctagtgttccctgaggcttactcctcagacctcttttctgtgtatttgaggaactcatccaatctcatgtcagtgattgtcctccctgcacggataatgcccagatttttatctccagcttggacctctaaacctcagaattttacactctcatatcctactgcctacttgacatctccatatgtgaaacttaataggcatctcaaactgaatgtgttgaaaactaaactgattcttcctccttcctctcctcacctcaaatcccacccatgctcttatacgtcatattcagttcatcagcaattcctgactaaattcatggtttatccaaaatttgaccacctctcatcacctcttcagctaccatcttggtccaagtcaccaacatctctcatgtgggtcactgcaacagcctcctgatttgtctccctggttccacagtcgctctccttcagaccattctctacaagaagccagaggaattctggtacaatgtaagtcagatcaagtgtctcttgtgcttaaaacttttcagtgacttctatctgattcagagcaaagccagagtccttacaatgatgtacaagccctacctgatctgggtcccacaccccctctctaaattaatctatgtgagtcagcccctgcccccccccaccccgctctctctctctctctctctctctctctctctctctctttcttcatttacccccctttcattcttccctggctcaccagttcctttgctgttctcgaaacatactcgttttgctcctgccacaggacttttctacttgttactctcttttcctggaatgtatagatatctacatggtttactccttaacactttcagatcttcactcagatataacttcaaatataagcttcattactacccccctccctcacacaaatgcatatcattatccttcttccttgctttgttttccctttagtgcttaactctagggtaattttatgccatggtttgccagggacagtctgtttttttttctgttgctcacagctattaattatttttagctcctctttctactttcagtagaagcccagcttggatgataaactatgtggttagtctcctcatcactattttacatgctatatatttatattactcgttgtctgtgtccctactctagaacttaagttgtataagggcaaaaatttttgttctaatcttcacctatccctagtacctacaacagtgctttgcatacagtgaggattcatatattgcatgcatgaacaaaacattgtttaaaaatctgttcttttgccaggcgtggtggctcacgcctgtaatcccagcactttgggaggctgaggcgggcggatcacgaggttggaagttcgagaccagcctggccaacatggtgaaactctgtctctactaaaaatacaaaattagctgggcgtggtggtgcgtgcctgtaatcccagctactcaggaggctgaggcaggagaactgcttgaactgggacctgggaggcagaggttgcagtgagccgagatcacaccattgcactccagcctgggcaacaagagtgaaactctgtctcaaaaaaaaaaaaaaaaaaaaaaaatctgttcttttttttttttttttttttcctttggagacacagtcttcctctgtcacctaggctggagtgcagtggtgcagttttggctcactgcaacctccatctcccgggcttaagtgatcctcctgcctcagcctcccaagtagctgggaccataggcacgtgccaccacgcccaggtaatttttgtatattttgtagagataggggtttcatcatgttgctcaggctggtcttgaactcctgagctcaggcaatctgtccacctcagcctcgtaaagtgctaggattataggtgtgaaccaccacgcctggcaaaatctgttgttttatgataaaatatgttcaaatgtttaaaaataagtctggcccctttaagaagagtttatgaggacagatgtcgtcaaaattgctattggtgtaaaaaaaacatatttgtgaaattgctgttggaaactagtggagatttaaagtgcagaagttccaaggaaaaggtgagacttcttaaaaatcaaaattaattatttccattgtggtttgtcagtgcctctttgaaatcagatttattttcaggtttcagctctattacctccctaattaagaataagattctaccttcaagaaacttgtatttttataaaaaaatcaaatgtatagtagatgcgattataaaaaaaatgtgatatctgctttaacagagaaatatgtatttgtattccatatacaatctccacaaagcagagaccttttgatattacttaaatcaggtggataaattttctaagaaggtgatgcttgaattaaatattatagtttgaatagcaatttgtttaaaaggttagaaagggaaaagcatttgatggcatagggagtgctatatatatataaatatagctgtgaaagaaaattgcatttttagtgaatagcaagaagtatacctgtctcttctgtggcctgtgtactgtggttgggttgtttatctttgtattattgagttttgagagttcttcagataatctagacatataaatcttttatcagatattgcagattctttctccaggtcagtggcctgacttttcattttcttaactgtcatttgaaaagcaaaaagtttccaattttgatgaaatcatattatcagttttaaaacctgtttttaagttttcatcctatctaaatttgtagaagtttagttttagcactgcatgttctcactcataagtaggagttgaacaatgagaacacatggatacagggaggggaacaacacacaccagggcctgtggggtgggggcaggggagggagagcatcagggcaaatagctaatgcatgcagggcttaaaacccaggtgataggtgcagcaaaccaccatggcacaagtatacctgtgtaacaaacctgcacattctgcacatatattttggaacttaaaaataaaaaaaaaagttttagccctcatatttaggtgtgtgatctacttttagtttatttttgtgtatgatgtgaagtaagggttcaggttcatttatttgcatatgtatgtccaattctttcaacactatttgttaaaaatattatcctttccccattaaattattaaatccttggcacgtttgtaaaaatacattgagtaaaatttgatttgtggataggatggaggaagcacacttcctctgtctcccctgctgagtacagctataaaacctaggcagaatgcatggaacagctatttaaagacacagaaaataaaataccagtaggctatcaggaaagaacaactgaattcggagtaccgatgaacccacagtgaatttaccattttttcctctagttttcctgccgcatggcccctgacactgcacagcagagcaggatagctaaagcccaagatttctgcctagagcacccaaaagggaatttccagggaagtggaaagtgctggagatggaggacaaggagagggagttgctctgaaaagcaaccacatagctgcacgagcttggatgtgttcctaattagtatatcaaagactaagaagtgaacaaaaggatagaccactgcaggttggaacgtgtgacttgaatttactcaggttgattgcctgctaaagcaaaaaatcaaaatcctccataggatttaaacaagacccagaatctcataatattcaaaatgttcagagtacaataaaaaattagttggcatatgaagaaccaggaaaatattcattcacacaaaaaaggacaaagtatgactttatgtagataacattaaaaatcaataaattagaatgcagaggaagtaaaattgataaaaccaagtgctgtttatttgaaaataccgataaaaataagtaataagaagagaaaacacacaagactacaaatgagagagaggtttctatccaccattacagaaatttttaaattatgctaagtacaactgtacaccaatgcatttggaaatctacctgaaatagataattttcagggaaaacacaaattaccaaaatttactcatgaggatgtatgcagtgtttttgtttttgtttttgtttgtagagacagggtctcactatgttgcccaggctggtctcgaactcccagcctcaagctatcctcctgccttggcctcccaaagtgctgagattacaggtttgagccaccacgcccagccagatgtacgtgttaatctagattggctatgacttgctgtggtagtcattcccagtcctgggggctacatgtccattataggtcaaggattgctctgctccatgtttactttactcctgaatccaagctaatagaaaagcccctagctgggacattgccagtcacatggccaaacctacatcatgagagggaaatataatcctgtttcagggaagggcaatgaacatatatgaaaacggtcaatattatgaaaacggtcaatattatggttgaaaactgaatctaaccattaccatgaaataaatggaaagattgtcaaagatctatacccctttccacgcacacaaaaaaaggaatgctggaccaaaaagctcttatgagtgaattctatcaaaccttcaataaacagaccacccccacgttatttaaaatattctagtgtatagaagaagacagatttctaatagtttcatcattcctgaggccagcataaccatgatatcaaaacctgacagaaagcacaaaagatcaccattttccaatgtgttattcactgaaatgtctgttaagatgcttcagaaagtgagttattttgtcatataagttgaggagatgctgtataaaattacctcccaatggagagtcccaatataccatagtattcagtagtcctacagaatactattttgctttatttaatccacaattttctgaatttgtttgactgtaggtgccccccaacacacacctagattctttgtaatccccatggaatacatttctggaaatggtattatgaaccaatctgaagcatgaatttaaatgcaaagatcctaaataaaatgttagtaaattaaattaagcagtatttaaaaaatacactatgaacaagtagagtttattccaagaatgtaagtaaatatggtttaacataaacagatttactaatataattaattacattcacaggttaagggaagaaaaccatttgatttcctcaacgggtaccagaaagacatttgaaaaagtcaatatgcattctttctaaaagcacttagtaaaataataatgcagcgaaaagttccatagactattaaagataatttaaggtcaaaatgctagaagcacgtaacagcaggaaaaagacaaaggtgcccaccaccactgcagttatttaccattttactccaagatctagccagtgtaaaaagacaataaaaagaaatgaagtataaatattaaaaggaagagagaacattatcattacctgtagattataatgtctgcctggaaagcagaagagatcaactgaaaaactatttgaggtaataagagagtttagtaaggtgtctggctacaagatataaaccaatccacagatttcctacatgctagcaatgatcaattagaacatataatgagaaaacgagtcattccaatgatagcagaagttataaattaggaataaacagaaaatggctaaacttagaactataagaagttactgatggacataaacaaggattaaaataattgaatgacatattcttgggcaaatattgtaaagatacttgttcctgccatatatcagtgtcagtaaattaatgcaacttcaatcaaaatcccaatattaccttaggggaaacttgacacatcttcaggttctaatatactgcatgagaataacaaagacaattttgaagtgacaaaagataataaaaacatattacagagttactgtaactaaaacaacgtaggcaaggatagaaaactagattaatgaactaaaaaagctaagtccaaaaccagacccatgtatatatgacagtttaatatttgaaaagggtagaatttccaattattaaaggaacaatggaatattctccagatggtggagggacaaatagctagtcatttgggaaaaatagttcttatccctatctccacttcctatacctaagtcaattcctaagggaatcccaaatccattataagaaatcataggaaaaccgttttctagtttttgagtggggaaggcctatctcaacctaacatcattgccaaaaaacattaagacaacatactgtacaagaaagataacataagttacatggcacaaaaatcaaaagatacaaaatgttatccaatggaaattaagtcttcctcacagcttgtcttccaggcatcagttccccaattctgagacaaagactgtttccagtttattgtagacaacagatttaatcacctatatatgacagacttctgtattaaccaccagaaagcttaagaaatcagaaaaacctaaaaaaaattgcaacatatgtgatgaataaaaaactaatttacatatataaggagatcatactaataaataggactacttcagctgcaagccacagaaaaccagtaaccaagatatgcacattaaaaaatattgatctaatcaattatatcaaaattttaaatgtatattttctttgattcataaattctatttctaggattttgacttgaggacataattagtcaaatatacaaagatatatatgcatcatagaattgctttataacagcaaaatttgcacataacctgaggattgattatataacttgtatatccatacagtggaatactattgtatcaagagactttcagctataggtggaaaaaaactgcacaaactaaaatgggatttattactcctgtaacaaggaatcttaatatagggtgactccagggtaattaaatctgtagttcaatgacattatcaaggacccagttttcttctatctttgctctgtcatctttagtatgtcaactaactcttgatcacatttagcaaatatgtacaggtactgataaactgtaaagatataatgattagcaaaaacagacatagtttctgtccttgtgtatttacagggaatatacaacatgtgaaaaaggtaatggcatagtatgtgttacatgataccctttatgaaaaagattcatttcggggcaaacatattatagtatgtaaccttttctggtaagattgttatgtgatgttcaccaaatgccagagcctgtgctaagtactttatatggattatctcattttatcctcacaactctatgaattaatactattattatccaattttatatatgtgtaaactgggactcagagagattgaatcacacataaccggtagtcagaatttgaactcatgtctgttttattccaaaatccgtactcttaaccactatgttaaacaaccttttgaaaatggaaataaaaatatatagaaagaaatagaccaagcttttaacagtcattttcttcaggaacttatggttgaatgctattgactacaagagccaggaaaaacggggaggaaaacaaaatccaggggtacattgatagactggcagtggggactggttgattgcctaaaacgtcctgaagacatttaaaagcaggtctcataggagagagtgagcaaccagaacttataatcagaactctagaggctgtataaaatttggtaatgcttcaagatagggacatgtgtgtattttactgatgtgaagtaagaatcaaggtcattggattaaagtagagcaagaaaacaatcattcattcaagtatgtatagatgattcaagcacctaacttgctacaagttagagaaatactggtgaacaagatgagtaagatttgtagccatgttaagaaatgtagggtttatttggattttgttctaaatgtgacaataaaccatcagtgggttttaatcagaggaattacttgatctgacttacgttgtgaaaagatcactctggctgttaggttgagaatgtatcatgggagtgggaacaaggactagggaggctagttaggaagatagcgaagtaagagttcatagtggcctggacaaacgtgatatcaatggagatggagaaaagtggcagacacacacacacacacactcacacacacgtacatatatttatttatatatttgtttatttatttgagacagggtcttgctctgtcacccaggctggagtgcagcggtgtgattacagctcactgaagtgatcctcccacctcaccctcccttgtagctgggactacaggcatgtgctaccatgctgggctattttttttttaggagagatggggtctcattgtgttgcccagggtcagacacatattttgaagttagagttgacagtgctagatgatggatttgatatgagaaatgagggggagtgaggaattaagaataactcccaatttctgtgaatggtggtgtcatttatagagctgaggaagaccggggttgttggagcacattttgatagacgttgaagacattgattttagcattggatatgttgagtctgagaaatctgtggctttgtttagtaggcaagttggctgtattgatataacgttcagaaaagtgagctagagttactgattttggaatcagcaatggaaagatggtaactgaagtcacgagagtgggtaagattgtctagggagaggagaggatagagagaagaaagagagaagagaattggtcctctgacagaactgagaacaccaagttcctgagaggcttaatataggcagcaatcattccaccaacactatgccggcaaaggccactcatgacttcctgttctctcaaatcttgcggattcattttagtttttatctttctgaatcgactgctgcattttgatactactgttcacaccatcctataaaactgtactctccaggatttcattgtctccttgtaagtttcctttcccttttctgtgtgccctacactttattgttacccagggaagactaaagagtaagactctaggttgagctgtcagcaatgacttttggagccacgtcttccctaggatgaggaaactgcttccaactcttggaagctgctggctccagaacttgatgaaggtgagcgagcaatccatgcagatatctcaggaaaaagaattccagacagagggaaaagcaaatacaaagtccctgaggtgggaatgtgcttaagtgtgtttgaagaacaggaaaagaacccatgtaactggagtaaaataaagagggttagcagtaggaaatgaggttacagaggtgatgagatggagatggaatttatttccaagggttcttctgcaggccattggaaggactttgggttttaagctgagtaaaatgtataaccactggaaaatcatgagtagacgattgcttataactaatgttttatcaggctccttctggctgctctgtggagaataaactgcaagcatggcaggggtggggaaggggagacgacaagagtggcagcagggagaccagctgtcacaataactcagaaaaatgatagtggacagcaccagtgtgttagcattgagaatggtgaaaagctgtcatattctggttatacttttaaggtagagccagcataatttcctgatagatcagatgtggactatgaaagaaaggagtcaaggatgataccaagatttttggcaaaggtagatgaaaggacaaagttgccatttactgaggaggggaagactatgagagggacatatttggggaggaagattaggagcctgatttgggacatgttaaatttgtgatgcctgatagacattcaagtgaggatgtcaggtaaacagttggttataaaggtctggagtccatgggaaatagacaagttgaagataaaaattcgggactcattgacttatagatttaatttatagccatgggactgaatgaagccaccaagagaattaatataaatgaagaaaaaatgatcaagccctggggagcattttaaggagaaggagatgttacattgttgttgttttcctttcttctttccttcttctccccttccctcccttccattccctcttaactataaaagtgataaagctgtacagaacttaggctacctatctacttatgcccagactcagaatccattatctttcctttttttttttaaccctccccccaccctcatgtgtactatcaatcctgggaaatgtgctgaactattgtgttcttatgttggtgccacactgtaagtgatcctggcataaaaagcatgccgtagtaggatttgaaaaagctgaggcaacttagcctggaaaaaagaagactttccagggaacataatagttgtaatcaactacttggcaacagaattaagactcttgattaaaaatcatcatgatgaagatttaggcttgacagaaccaacttttctcaaagtggcatatgctcaccaggaagtattgaggtcccagggacttttgatatgatggtcagataactttcaaaaattatattctctttctggctttaaggtaatggtgaatacgattgtgtatggtatatgtcacatcttattgatatccttggtagtagttgctacgctgtagtaacagattctggaaatagctataacacacacttggaatctcacagtcacataatcaatcattttactaaatacaagcatattttcattcacatacagctaaataaagcatttttcacatttcattacagtgcacaacaaagtgaggaaaagtatacagtacattttattctgaaatatgagacaatctaatccaacatgcagttgtggtctttgttacaagttagtttatcttttctttacctatgtagtaaaatagcttctaaagctttatccttagtattatattaacacctgattcttttcacacttattttctaaaacccacttattgcagtgacaatggtactgaattctactaaaatgatttttaaattttctagaacttatttaagcaattaagctcagccacctctgctggatttatgctgaatatttttaaacctgccagaaaatgccaggagtgggaatactgtacatataataaattttagtgaagaaaattgtagggaagttttgtttctttccttttttgaactgacagaatccagtcgactctcatttacccactggataatcttgctttcagaatcttctaaacataattcagtatagcagttgatgaaattttgtgttaatgaaatttgccatgttttgtttgtcttttacaaccacgaaggtggcaatttaattaccccacctaagccagctcttgtgaaatgaatatagagaagatgatcagttcacttgtagttaatgctgtgaactgatccaaagtggtttgctcatccaacttggggcacaggtggcagaatagtcttccataattttcatgatttggtttctttattctggctaaagcaaattcccaaagtttcagattcggtcacattcatactgaagttcaatattatatctcaaagcgatttgccattcttaggccttcctatcacgatggatatgagaaacctgactctagtcagaatagtttttttttttaattgtgaaaagtatggcttttgcctagctgaactggctacaatccaaaaagtaatttaaagcatcacctctcttcaagaaaataatggaaacttcaagccagccattccaatttgctgatgcagttagctgtttgttcacctgagaattaagggctgactctcttgggtagacaggaactcagtgtacgtatatggcagacaggtggccaaggtcattttggggtgggtattttatccctatcccactccgcattgctgtacgtggttcctttcaataaaaatccactgtgtctcagtgataagaacacttatagcccacacagttctaatgtctttttagttgtgcaattattcacttgtttaaagccctcttgtcaataatgcctgaatgggctttacctttgattccttcccatgttccctcaggattatagctgagttgtaatcaataaggaaaacatatcctaacatgtagagaacatttatttatagtcatatctcttcccaagtaaacaaattcataatcatttattcatctgacagcagtatgatgcagtgaaaagagctaggagtcacgagtccttgaccctggccaagtgattttcatggctcttagtttactattctgtaaaatggggcaaaaacctcgtaggcctgttatgatgatcaaataagtagcccaagtaactgtaagctgtttgtaagggttacagtgcctcctgttcagcaggagagagtgtttgcctcagggctcttttcagaggcagtcactgtgttgtcactgtcacgtgcctgaagaagcaagcagactgtttacttccagattgcaggtgccaaggcattgaaaccccaggcatggtcaaaggaaaaagggggtatggcatttgggttatagtgtctctttcctagttatagggtaatttgcatgggacaatttgtttcatacagctggtaattctatcacaagggtgttcattttctgaaatgtgctaataactgtgtcgattgccttcctttccatagtcacatcatttttacttgaacaccagaccttttggtctgtgttcctcattttacagaaagctgttaaaagctaattggtaccttttaaccaaacccagcaaacacctttggtgcagggtattctcacggaataagtagagctcataatctttgtttagttatgctaattgtccccattgtgaaacttttttcccctttatgtatttctttatgttcatggcctataagtgagctcaaataccaaggaacagttgtcctgtctgtaggtatgttttcctgggacttagcttcctaaaccccaggcctttaacatgtggtccacaaagggctcatggagcagccactgcctagcatgggccacaaaacagtgcctggcctggcccatgtcagcaattcagtcccttggtcacagcactcaggcacccccatccacccgcacacgagtctgtcagagtccccctgagagggaggctcacttggtatccaaatggaggttgagttctcatcagttacacaaagattctatttatttctcttacttttcagttcaagtaggagagcatgttttggaaataaaagaactgactagcacaaacatctcctctctgatttgacaacctcttctgaagagtgaaccacatttggtacaaatccactcttcaccccttcccagccctcctggattgtaatctccccccttttaaccagctcatatatgtctcttgtcaggtctgtgaaggctttctccacattaatggcatctcgggctgacgtttcaatgtacttcatgccgtatgcagcagccagtttctcggcctcgtggcgagtcacttgcctctgtgtatccaggtcacacttgtgacccaccagaacaaatacaatttggtagggctgaacgtgtactttggtctcttctaaccactcatggacattctggaaggacctgcggttggtaatgtcaaataagagaagaccacctactgagttcctgtagtaggcgcgagtgatggatctaaaacacaagaaagaagtaaagagtaaaggctgtgcccaaacttctgcatgtcaatgaactcagtatattcaagtgttcctggttagtgacacagtcctttaataaaaatgattttctttttttttaaaaaaacaaaggaatacaaatggcattccatactactactaatatgtgagtttccaattgggccaaactttgagatgggcatcttctagaaacgaatgttcatgaacttttaggcattttccatggattcagcactggagagtgaccctgggacataactgagttctatttcttgccttcaggtaaaactacaactaactctcccaccccccaaatctgaataactgacagagacttccttttctgcaaaataggatacccaagtcacagtgttaccatgaggcaaaatgaaacaatggatattaaagtgttctgtgacgtggagagttcattacaaatgctagcagttgaaacaggatttttaaaacatagaaatgaatttatgatagttaacaaaatatttaaagtaggtatcttgctactccattttttccatttatcattaccatgtttttttctctttccattattattattgtttattattattattattattattattagctaacagggatcctcaatctcttctgtgaggagaaacacaattttattttttattttcaaggcctgtgggaatgggaaaaagagagatggcgaagggttcaggcaaagtgcctctcagccctgtttcctgacacatttcagagaggccaactcaactcaggagccatcagaagaaacttcacatgttttaacttcttgacttgaggaacctcattataaatatacattatggcactttgcttacagtgtattaaagcttattacagggtatggacctatttgtctctgcagtcacttgctttagactactgtgattttttttacctatgtctatttttaggttttctgtctcctcagataaagaagatagacaacgaaggactcaatagcttagagaaaatggctcaatgttagcagaacaagcattgtccagggacctacagtccaagctagatgatggtaaaagtaaaacttacaaatgactttaagtctccaaaatcaggcaaatcagccctggggactgaaagcatttctcgtctcttaggtttgaagattcatggagaatggtagatttaccagaaaatttagacatgaacaaacaaaggttttgatttgtgagaaggttgattcaagaaatcaacaagcaagctgtagatcactgtcaaaactctggaatatattattacattaattgtttgtgagtacttagcaaagaaagtgacaaaggccttctaagcatggacataaggctacataaaccttaaattcttccctacattaaaaaatcttaaataatgtgaaaagacagatgataaactaggaatatatcttacaacatacatgacaggaaagggttaatattcttaatctataaagtactcttacaagtccatattgcccaataaataaataagcagtggatatgaacaggctgttcatatagaaagaaattccaacaaacacataaaagatacctttctttgcttaggagaaatgcaatcgcaagttcaaagtgaacctgtacaaggatattttccacagtggtgtttgtggaagtggggagctggaggtaacttaagtttgtaattatttcttctccttacccctcttcaattacccaaccagtatcttctatgcttagttagttttcaatagataaatgagtaaatgatcataaacttgggctattgagttttcttgatctggttcctgctgctctactttagttcaaattgttctctgcaaagttttctgtgtacactctgctccctctcacttctgtctttattcatgctgtttcctatccctgggcgtttcctgtctttgcttaggcagtcatactcatccggtctcatcttctccagttaacctttcctcctctgtgttcatacatataattacaaataatacatgctacaatagaaaagcaaagggttctgagtgaaagtaaacatattcattgattattcaatgaattcattgattgaaattaagcatgttcattttgtgccaagtgttacagtagggagtgggcatacaaatatgagcaagacacactttcgtaattgctgattatctatttccctcaactatgttagcacagaagttccaagaatgaaggggctttgtctgtttagattacatggcatccccttgtgtgagtctcctcacactgttttcccaggaacaagcccagagtctggcacatagtagatgatcactgaatgtgtgctggttgcaagaaggaatcaatcgtatctatttcatgttagaacatatgttagcatatatatgtgcacacacacagatgtggaaataaaacataatacacatgtatttatgtatttaaatctctgtcagttatgttaggatgacctgggaacgtttttgaaagtatgtaacatagggactgagattgatgaattacagatacagagatcaattccagctagtttattagccaccaaagggcaggttggtggagttgtggtgcaagcaatatgtgttattgaccggccttccctgccagggcgcttctttccttgcactaaactccgggttagccgaaggtgggcttcggcagaatcctcaagacccttggtgttgccctcctggaccgcacctagaaccaggaagtcctctctccccagaggcggtgcaaaccccgaagaccctcccactgcttgcgggcccggactgcgctcccacctgaacctctcttgacccgcggtatcccagatctggagcttgatgcgttttcctggctcgatctccaccaagcgggagaaaaaatccacccccacggtggggtcagaaacctgggcaaagcgaccctcggtgaagcggcggatcaggcaggacttgcccactgtggaatccccgatgacaatgagccggaactggtacagccagatggcctccatggccgcggctctgcaggtctccttggcccggaccggggacggcgggagggggcgccccgccgacgcctcagagagcgcggctcggcaggatctagctcagccgcgagcgcatcgctggcctgggagcccgaagctgggtaggcccaggcgccgggagagcggagggatggatgctgcgctcgcaaaggtgatgaaatggcagcagcatcagcaccacgcactctgactcatcactgacaaccgggttactgtaatcccccgcgtagacgcgacgcctgggccgccgcactatctgtaagaggagcgcacacaaaatggctgcaacattagcgcgatccctccctttctaactaccccacccaccctctgttcattaaaactgttctctgtcgttcaaactgccaatgtcataccttttcattgaaactagcaaagcaatacaaaactgcacaaaaaagggaaggcacataattatatattagtctacaagtgtttccatgctcacataaacacacaaatattatatgtgtttgtattcctatatgcatttattgctgtttgtttttacaaaaattaaactggggccttactttcaattaataatcgctttttgcaattaataaagcatcataaatatctttccatttccacctaatttcccttttgtcataacttattttaaagtgtagccacaagtattttatttctgtgagctacagtcttaaaaaaggggccatgaattcaaagagtataagtattttaaatttaacggacatgggcattctactttccaaaactatttaacagtttaaattctacccagcaatgtgtgaaaagaccatcgctctgcattatttcaagcatcatatgtatgttttattctttcttaattcttctcaatagaatttagttaaataaaaatatgtctcattgctttatttttacatttctctgactactgatgaggtcaataccaagtcttgtgtattgaccatttcatttcctcttctgggaattgtctcttcatatcctttgtattttttatgtgtaattttattttatttttttttttgagacagagtctctctctgtcgcccaggctggagtgcagtggcgcgatctcggcccactgcaacctctacctcccgggttcatgccattctcctgcctcagcctcccgagtaggtgggactacaggtgcccgccaccacgcccggctaattttttgtatttttagtagagataaggttacactgtattagccaggatggtctcgatctcctgaccttgtgatctgcccgcctcggcctcccaaagtgctgggattacaggcgtgagccaccgcgcccggccttctatgtgtaatcttttatcgttgccttactctttaaaaaaaatcagcttcattaacatgaaaattcacatactgtacaattcacccatttaaagtgaacaattcttagcataggtttttagtatactcacagatatatacaactatcaccacagttaattttataacatttttatcacttcaaaaagtaacccagaggggtgggggtaggggggagggatagcattaggagggattacatttacctaatgtaaatgtaaatgacgagttaatgggtgcagcacaccaacatggcacacgtatacatatgtaacaaacctgcacgttctgcacaggtaccctagaactaaaagtataataaaatatgtatatatattttttaaaaaaaggaacccagaaccttttagctatcatctctctatcccatgttcctccagcctttggcaaccattaatgtactttctgtctctataaatttccctattctgaacatttcatatacatgaaatcatataatatgtgcatttttgtgactggctgctttcacttagcataatgttttcaaggttcattcacactgtagcaagtatcagtacttcattcctttttgtggctgaatactattccatcatatggatagaccatatcttgtttatccattcattcattgagggacatttgggttgttcccaccttttggctattctaaataatcctaccatcgaatattcatgtgccaggttttttttttaatatctgttttcagttttttgggatttatacctaagaacggaattcctcagtcctgtggcaactctatgtttaaccctttgatgaaatgcctgactttttcacagtggctgtaccatattacatcccactggcagcctatggggttccaatttctccacattctctctaacatggatgtgaagtggtactttattctagtttgatttgcatttccctaacgactgatgacttcaagcatatttttacgttcttattggccatttgtgtatcttccttggaaaaatattgacttagatcttttgcccatttttaaactggattactagtctttgtattattgagttataagagttctttatatatgctagacacaagtcctttatcacatatatgatttgcaaatattttctccaattcagtgtgttcttttttttcactttcttgagggtgtcctttgaaaaacaaagttagatttttaagaagtataatttatcgagtttctattttgttgctcatgcttctggtgtcatgtctaagaatactttgcccaatccaaggtcatgaaggtttactcattctttcttctaagagttttatagttgtagttcattcatttaggtctatgatccattttgtgttcgtttttatgcatggtgtgaggaaggggttcaaattcattcctttgcatgtggatatccagctatcccagcactctattgaggatactattctttctctatggaatgattttgacactctggaaaatcaattgaccatggatgtatggatgtatttttggactttctatttctatgttaataaagctgatttgttttaaaacagtaaggcaatgataaaagattacacataaaaaatacaaagtatataaagagacaattcccagaagaggaaatgaaatggtcaatacacattggtctatatgtctgcccttatgctggtatgacactctcttgactgttgtagctttgtagaaagttctgaaatcagaaagtgtgagtcctcctactgtggaggatccaatcttttcaaagattgttttggttatttggagccctttgcaatttcatatgaattttaagaacagcttatcagtttctgcaaataaggcagttggaatgctaataggtattgatttgactctgtagatcaatttggagagtgttgctgtcttattaaaattaagtctttcaatccatgagcacaagatggatatcattccatttatttaggtttttaaaacttgttttaacaatgtttcatagtgttcagtgtataagttttgtacttcaagtattttgttatttatgatgctattgtgaatggaattgttttcttaatttcatttttagattgctccttgcaagtttataaaatggaattaatttttgcatattgattttatatcctccaaccttgctgaacttgcttattagtcctaatagtttttatttatttatttatttattttaaatagtaagttctgggatacatgtgccgaacatgcaggtttgttgcataggtatacacgcgccatggtgatttgctgcacccatcaacctgtcacctacattaggtattttttctaatgctatccctcccctacccctccaccccccaacaggccccggtgtgtgatgttcccctccctgtgtccatgtgttctcattgttcaactcccacttatgagtcagaacatgtggtgtttggttttctgttcttctgttagtttgctgagaatgatggtttccagcttcattcatgtctctgcaaaggacatgcactcatccttctttatggctgcatagtattccatggtgtatatgtaccacattttctttacacagtctgtcactgatgggcatttgggttggttccaagtctttgctattgtgaacagtgctgcaataaacatatgtgtgcatgtgtctttatagtataatgatttatgatcctttgggtatacaaccagtaataggattgctgggtcaaatggtatttctggttcaagatccttgaggaatcaccacactgtcttccacaatgcttgaactaatttacactcccaccaacagtgtaaaagtgttcctatttctccacatcctctctagcatctgttgtttcctttttttttttttttttgagacagagtctcgctctgtgggccaggctccagtgcagtggcatgatctcagctcactgcaacctccatctcctgggctcaagcagttatcctccctcagcctcccgagtagctgggattacaggcacgtgccactgtttcctgactttttaatgattgccattctaactggcgtgagatgttatctcattgtggttttgatttgcatttctctaatgaccagtcaagctaccattgactttcttcacagaattggaaaaaactactttaaattccatatggaaccaaaaaagagtttggcaattttgttgttcttttcaaagaaccaacttttggtttcattgattctattgttaatctattccctttgtttcatttatctctgccctaatctttattattttcttccttttgcttgattttcttttagttagctcatctttttccagtttcttaagttggaaggttaagttattgatttgagattttttttcttaatacaggcatttatagctatacatttccctctgagcattgctttatctgaaccccataagttttggtatctttcttgtgtcttcattttcatttatctgaaagtattttctgattttccttttgatctcttctttgacccatttgttatttattagtattttgtttaattctcacatatttgtgaatttcttatatctttttcctactattgatttctaatttcattccatgtggtcagaaaacatactttgtattatttctatccttttaaatttcttgaggtttgtttttttggcatagtatatagtctattctggataacgctccacgtacacttgaaaagaatatatcctctgctgttttttatatatatatatatatataataaatatatataacatattatatataatatataacatattatatataaaatattatatattatatataatatatatatgtataaactgttatgtctagttggcttataaagacttagacataagtctactgtttccttgttgatcttcagtacagttgttctacatattattggaagtggagaatgaagcctccaactattcttgtagaatgatttttcactttaactgtcagttattgcttcacatattttggagctgtattgttagatgcatatatgtttgtaattgtatctttctgatagattgacccttttatcactatgaattgtccgtctttagtagctgtttttgttttgaggtctattttttctgatattagtatagtcacttcagctttcttgtgattggtgtttgcatgatatgtatttttcatcattttactttcaatcactttgtatctttgaatatgaagtgtctgctgtagacagcatatagttgtaccattcgaaacatctagccatataatctttgcttttctttaaacagattgtttaatctgttcacatttaatgttatttattgatatagtgggatttatgtcagccatttatttgtttttctgtatgtcttaatatttttgttcctctagtcttctcttattgctttcttttgcactaagtgaatattttttgatgtaccatttgagtttcttaattcttgattaaaattttttcactatattttgaagtattttttagtggttctttagagcttaccatatatatcttgacttatcagaatcaccttcagatttatactagctttattctagtgacatatagaaacattattcttatatagttcttttttttttttttgagatggagtctagctttgtcacccaggctagagtgcagtggcgtgatcttagctcactgcaacctccatctcccaggttcaagcaattctcctgcctcagcctcccaagtagctgggactacaggcctgagccaccacacctggccaatttttgtagttttagtagagatggggcttcaccatgttggccaggctggtcttgaattcctgacctcaagtgatccacttgcctgggcctcccaaagtgctgggattacaggcatgagccaccctgcccggactcctgtatagttctattgtcttgtctgtctttttatagtactattgttatgcatattatgtctattaatgttacaaacctatcaatgcattgttataattattgctttatcatctatatttccttatccaaatatagctttgctctcagccacctcttttgtgttgcttttggcaaatatactgcattctatgttatagactgaaaaatacattttatacatatgttatggaattgctttgttaatcaattaatagaaaaaaaggaaaaatatacgtttatgcagtcttctataattacataattactagtgttctggttctttatttgtttctgtggatttgaattatcatctgagatcacttgctttcagtctgaataacttcagtatttcttgtaaggtggacatgctagcaacaaattcttcagtttttgtttgtttatctgggaatgttgttatttgctttctttttttgaatgatagctttgttggatataaaattcttgggtgacttttttctttgatcactctgaatgtgttacctcattgcttttgacctccattgtttctgctgacaagtcatttgttaatcttattagggttcccttgtaagtgataaatcattttttcccacttttcattttttatttttaatttttatggtacataatagttgtatatatttatgggttacatgtggtgttttgatacaggtatccaatgtgtaatgattgaatccgggtaattggggtatccatcacctgaagcccttatcatttctttgggataggaacttagaattctactattttagttattttgaagaacataataaattagtgttaactgtagtcaccctattgtgctgctgaagactagatgttattcattctatctaaccatccccgctttattccccttccactactcttcccaccctctggaaaacatcattacactctctatctccattagttcaattttgttttagtgctcacatacgagtgagaacatgtgatttttgtctttctgtgcctggcttatttcacttaatataatatcctccagttctattcatgttgttgcaaatgacaagatttcattctttcttataaccaaatactatttcattgtgtacctgtcagacattttaaaaattcattcatctgttgatgaacacttaggttgcttctgtatcttggctattgtgaatagtgttgcaataaacatgggattgcagatatttcctcaatatattgattgcctttcttttggatatatacccagcagtgacactgctggatcatatggtagttctatttttttttttttttttttaggaaccaccatactgttctccatagtggttgtgttaatttatattcttatcaacagtgtatgagggttccccctttttcaccatcttcaccagcatttgttattgcccatcctttgcataaaagccattttaactggagttagatggtatctcattgcagttttgatttgcatttctctgacgattagtgatgttgagcattttttcatatacctttttgccatttatatgtcttcttttgagaaacgtttattcagatcttttacccgtttttaaattggactatttgtttttttcctattgaattgtttgagctccttatatattctggttattgatctcttgtcaaatgagtattcttaaatattttctcccattctatgggttgtcttgtcactttgctgattgtttcctttgctgtgcagaagcttgttagtttgatgtgatcccatttgtccatttttgctttgcttgcctgtgcttttgaggtcttactcaagaaatctttgcccagaccaatgccctggtatgtttccccaatgtcttcttgtagtagtttcatagtttcaggtcttagatttaattatttaatctattttgatttgattcttgtatatggggtagtttcatttttctgcaaatagatatccagttttcccaacaccatttattgaagagactgtccttttcccaatgcatgttcttggcacttctgtcaaaaatgagttgactgtaaatgcatggatttatttctggattttcttttctgttctattggtcaatgtgtctgtttttatgacagtaccttgttattttggttactatagctctgcagtataatttgaagtcaggtactgtgattcctccagttttgttctttttctcaggatggcttttgctattcttggtcttttatggtttaatatacattttaggattattttttctatttctgtgaagatgttattggaattttgatagggattgcattgaaactgtagattgctttgggtagtatggatatcttaacaacatttattcttccaaaccatgaatatgcaatatcctttcatttttttgtttctttcatcaatgtttcatcaatgttttacagttttcatagtagagatttttcacttctttggttaagtatatatatatatacatatatatatctcaccatggaatactactcagacataaaaaatgaaataatatgttttgcagcaacttggatgaaactggaggccattatcctaagtgaagtaactcaggaatggaaaatcgaataccacatgttctcacttataagtaggggctaagtgatgggtatgtaaaggtttgcagaatggtataacggacattggagtctcagaagtgggggagggctggagggaggtgaaggataaaaaataccacctgttcggtacaatgcacactattcaggtgacagatacacttaaagcccaggcttcactactatacaattcacccatgtaaccaaaaaccacttgtacccctaaagctattgaaatataaataaattaataagcaattaaacagacaacctacaaaattgaagaaaatattttcaaactatctcataatggtctcatacttgtaatctataaggaacttaaacgattcaacaagctaaaaccaaataaccccattaaaaagtgggcaaacgatatgaacagacacttctcaaaagaagacatacggttgggcgaggtggctcatgcttgtaatcccagcactttcggaggccgaggcaggtggatcacgaggtcaggagttcgagaccagcctggccaatagggcgaaccccccacctctcctaaaaatacaaaagttagccaggcatggtggcatgcacctatagtcccagctacttgggaggctgaggcagaagaatcacttgaacccaggaggcggaggttgcagtgagctgagatcgtaccattgcactccagcctgggcaacacagcaagactccatctcaaaaaaatatatacatatggccaacaatcatatgaaaaaaagctcaacatcacattagagaaataaaaatcaaaaccacagtgagataccatctcacaccagtcagaatggctgttactaaaaagtcaaataacagatgctggcaaggctgtggaaaaaagggaagatttatacattgctgatgggaatgaaaatgagttaagccacagtggaaagcagcttaaagatttatcaaagaacttaaacaagctaccatttgacccagcaatcccattactgggtatctacccaaaggaaaattaatcattttagcaaacagatactgcacttgtatattcatcatagtactatctacaatagcaaagacatgaaatcaacctaagtatccatcaacagaggattggataaataaattcctctgtaatgggagatttgcctcttttcctccattaattaattaattattaattaagtcatttgtgtccatatggactcctctattttatactttgtgttataatctaatactgcattacagacaaacctcaacttatgaccatttgacttacaaattttcaagtttatggtgggtttattgggatgtaattgcgtggtaagctgaggagcatctggacttatggtttgacttatgattttttgactttatgatgggtttgttggggtactaaatgccttttcaacttacaatatttctaacttatgatgggtttattaagtcatagccccatcagaaggtgaggagtatctatattttattgaggcaatttttccaaatttggcaatctttcaggatgactcctctattcctttgccatgacttcatcttttttttttttttttcctcaattccttactttctggtgctatgagattctccaggcccatcttgtatttcccctgccttggtcctagaatcagttatttctccaagtagctctagttccttttattggagaatgatattagaatccaaggtcttagcattgggtgtgcttgttgctactagggtactattgcttctaggccctctcaggacacagggctaggaactatacatatgtatactgactcatgtatatacgcacatgtaattatttttgtatctattcacctctatcaatattaagttaaacttgagtacataccgatgtctctgaatcgaatccagtaccacatagttcatcctagccttcttgattatttgtacttcccacctacagttcatttacttattttttcaatcttagtatacatgtatggctgtttcagaattgtctacacatatccccttgagaaacaactttgccaattagagtacaatatttatgtatagtttctttatattttgttttatattttccagaagaaacactgtttcgcaaagttactttgagactatatggtcttttaaagtttggtagcatttccctgtgaaactatctggggattgatactttttggtaagtagttccttataattttctctatttcttctttttaaaaaatgttctctctttcttctatgaagattgagctcttcaattttcatatctctaataaagttgtttttcgtaatctttactttgctaggaaattatctctatcatctagattttgaaatttgtttgcacagaggtctgcaaagtagtctcttataatgtcttaaatttcttctaatagttatttccccattctttattttgcatacttttgctttctctgttttatttcaattaatgtagctaatggtttgtctgtattatcaatcttttaaaaaataaaggttttgattcgttaactaggtctatgctatttctattcttttgttaattcttactttttttgttaatctcttgtgttcttttacttaatttgttgtacttattctaagtttctttctgttttttgctggtgctctaccaagatccatttggacatttttttttaagttgtgttaaaaacacatagcttaaaactcatcaccttaactattttgaagcagagagttgagaagtgtcaagtatattcacattgttgtgcacattttaaaaatttttgttagttcaatatttaatcaatttattttcaatcttttatttttactaatagcagtgtttagttataaaatttcctctgatcactgctttatatttatcccatggattctgatatgaagtgtttacatcatcattatttgttttagagatcatgtagttttggtttatatttttcttttaaaccaagagttaattgaaggtttttaaaatttattttttaaatgtataatgggcacataattgtacatatatatgggatacaatgtggtgtttcaatgcatgtacacacagtataatgatcaaataggcgtaattaccatatccaccactataaacatttgttatttctttgtggtgacatttaaaaacctgcttttctagctatcttgaaatacatgctacattattatttgctatagtcaccctactgtggtgaataccaaaatttattcttcctaggtgtaactttatacccattgaccaacatctttcagtgcctctgccttctttctctccctagcccctggtaaccacgattctaccctctacttgtgtgagatcaactttttaaaattccacatatgagtgagatcaactttttaaaattccacatatgagtgagatcatgtggtgtttgtctttctgtgcctggcttatttcatttaacatttcaaatgtattctatcaattgtaacttgctagtgcattgcatgtattctgaaatatactgatgacaggatgtatctcaaagattatcaacatgattgcatttctctgccacctaaccatacactatacatttatcttgactctatggttttcaaggacagtactttgagtttgctcattgccttacttttctttgaacctattaaaacgctacttcatttaaattttatctaaactccacccttccaccaaagcctaaaatattttccttttttgaagctgcacttatgcttgtgtttctcttttgagggagcaagagttaagttcagcttttgtttccagatttgaatgatttaagagtactttaacaagtgaatctgaatacgtatagtaatgtaacattttaacttttgtagaaagttttgtaattatctaaggactgtttaccttatccttttatggacaacaagaagaccttttggtcagccacagtttttattttccttttcatttctatgaataaaagattcagttgactttgtttcttatattgttttttaaaattatgttttatttaatgagtgcttcttcatttaaaaataatataatctggtcacaaaggctacattctcatctctgaccatgaggtggtcatagttctaggcgtcaaatgctgttctatgaccaattgatcttgagctcttcctagagctgattttaaaaatcattctttaagaatttgcctctctgatatgctcactctctgtatttattatttatatcagaaataaactcatgtatatattaaactaacaaaaatgtgaaattattttagcgatttatatggaaatgtttctaaggagcagggtgagattgtacctctacttatgacatttataactgcagacatctgtttagcttatatgtatgcattccaggaattcaagcaaagggcaaaagattgtgatgctttccatgtcattcaggattgcagtggtttgccatacagataaagaaaattaagtaaaagtatgaagacctgtaaaatacagtggacagattatttatggctaatagaaaatacagagttccttttcataagagagttggatagaagaaacagtatttttcatattcttatttgcaaaaacctttctaatatgtcaataagtaaaatctgatcacaaatatagccttttctcctgtaagagctctcctaactcttctgtttagccacatttgcgtaagtattttcaatttctttgtcttcaggacacgtgtgggtaaattcttcacgggcataggcattgtggagataacgccagactcctgagaattctgctggaatgtcaaagtcacgatatttcttggcagcaacctagaattttgcaaaaaaaagaggaaaaagaaggcatcagtaatatgcctactatgtagaaatgtttcttagaagtcaagattatcaaaggcatcttatcgacacaaaaagcactataaaataaactatgaagtagacacgaatcttggactattttgatgttttgtctacaaatgttgacaaaactacatgcttacaatcatgttgatattgattctgtatttaattatgactatatttagaggaaggaaccacagaaaatgagcacatatccaccacgactagactaagagtttatttagagtcctatgtcttctttctttacatattctctgtgtttggcataggactcaaagagtaaattctgtgtaagtctatgcaataaatatttattaaatttatgattaattcatcataatactaatagcccaaattggttattccctattatgatctaggcactgttctaagcattttaaatgctttaatttatttaattctcttaacaattctgtaaaataggtaatattattacaaaataagacagtggaaaataccttctgatttagaaagaaagaaacaagttttggctgggcacggtggctcacgcctgtaatcccaacactttgggaggccaaggcaggcggatcacttgagcccaggagttcaagaccagcctgtgcaacatggtgaaaccctgtctctacaaaaagtacaaaaaattagccaggcgtggtggcacgcacctgtagtcccagctactcaagagtggggtgggaggactgcttgagcctcagaggtgggggttgcaataagccttgatcatgccactgcactccaacctgggtgacagagcaagaccctatctcaaaaaagaaaaaaaaagaaacaagttttaatacttcccagaagagaacattatggatcttccctctaaagagaaaagagatgtatatagtacacatgatgatgatgataatgacaaagctataatataataataccgcactggaaggtcactatgctttgtgctggcaactggcaaacccctcccacccattcagcctgccttataaagacttactttaataatgttcagcttgggtaacaagctacaatcagccagtgttagctggtccccatccaagaatagtcttctggaaactgggggttcctcagcactgtctggatcaatttcatccagaagtggggtgtttaagtagtcatccagacgcttgaattctttgagcagagatttttcaaaatctgaggcaatgaagtaatagagttacttgtaaatgtattgtcttttgactaaatacattctaaatatgctttccacacatttagacacctctatctatacatactacttacactggctcttcaatatctagttaactatttagaatgctcagctactcactgataagacaaagtaagatgaaatagtgagtgttaatcttttgggcttttcttagggaggtgcattggcaggagagtaaaagaaagaaagaaaagtgatcagaagagttagaaagtgaaagaaaaaacacagttcttgtgactcagaggataataaatctatttaagaatgttcatgggaaatggtaggtgccacagtttaagaaaccttaaaggtacacagtcctgcagttagttcacacctagtatgtcaatattctaattgagctatggttggtaatagctatattgaatcttgagttctaaatctaatacaacttcatgcgagggaatttcagaggagagtatagagaatgaggggaagactaggccagtccccaaaatatactatatattcaggaaaattctatttttgctgagtgagaagatgaagagtgagagaaaaatagagatttaaagaaaggtatcttactcttatttgcctccttttgtgtattcttaatgtatgcagaaaacttggcaaagaggttacagcccacatcaaaagactccttgtacttgggactcaggtgagggtaccttaaaaagaaacatgcgtcaactatcatttgcacataacatgacagagaccaggtgccctagcttgcactatactgaaaatggaagttctggaacattgtgctggaaactaaacacccttagaagtctctcagtagaagtttatattttttccaatctcagaacactttggtttctaaagttcacagggtaatcagttgtctggaatccaaagctcatttatctgtagaaacaatgtttcaaatggtggtttccatacttgctcctaaaagcctatttgtcagaagatataatgtcagtacaatacatttgcagacatgagtagtagaaaaatatggttttggccaggcgcagtggctcatgcctgtaatcccagcactttgggaggctgaggtgggtggatcacctgaggtcaggagtttgagaccagcctggccaacatggtgaaaccttgtctctactaaaaatacaaacattagctgggcgtggtggcgggcgcctgtagttccagctacttgggaggctgaggcaggagaattgcttgaagctgggaagtggaggttgcagtgagctgagattgcgccattgcactccagcctgggggacaagtgaaactcagtctcaaaaaaagaaaaagaaaaagaaaaatatggtttcaaatattacaacttataaaacaaatggtggaataaataggatggagaaaatgggaaaaaagtagccaatataattcaccacattaacaaatcaaataagaaaacccatttgataatgactagatgcagaaaagtattcaataaaaaatcagcacctcatggagatatctgtgctgccatgttcactgcagcattattcacaaaagctaacatatagaaacaacctaagttcccatcaacagatgaatggatatagaaattgtgagatatatatatatatatatatatatgtaatagaatattaatcagccttaaaaagaatgaaatcctgtcatttgcaacaacgtggatgagcctggaggacgttatgttaagtgaaataagccaggcacagaaagacaaatactccatgatctcacttatgtgtggcatctttaagaggtcaaatatatagaaaaaagaatagagcagtgattaccggggcagtggggggaggaaagagggagatgtaggtcgaagggtacaaagttgcagttatgtagaatgagtaagtctagagatataatgtataatatgaggactaataatattgtatactgaaaatttgcaaagggtagattttaggtgctcttaccatataaaaaagataactatatgaagcgatggatatgttaatttacttgactgtagtaatcatttcactatatatatgtatatcaagacatcatgtgatataccttaaatatatacaatacaaacaaaggctaaaacactcaattccttttcataaaaaaaaattcactggaagctagaaatggtcaggtcaaaaacttaggtatcttccttgattcctctctttccttctaactccacatttgatctattagcaactctggtcagcttacctttcaaaatgtatccagaatctgtccacccccgcgcccctgcccagtccaaagcctatattactgtaacagcctcctgactattctccctattcccatacttgtccctcatacacctggaatattctccacccatagacagagcaatcatgttaaaatgtaagtcatgtcatgtctttcccctactcattagcctgcaatgtcctcatctcagagttagagcccaagtgctcatagtggtctacaaggacccacatgatatgaaccaccttctttcccacccagtctattaaccacccagaagccagagtgatggctttcccctactcagtagtctgcagtcgtctcatcttaccgagtcacagcctaactcattacagtagcctataaggatccacatgatgtgatcccaccttacctctcttctctcatatccctcactcgctcaattatgacacagaccttcttgctaccattcaaataggcctggaaagctcctaccccagagccttttaacttggtctgcccgtaggtgagggggacacatggacatcccttgctcccacttttctttcaggtctttttcatgggtatctctttctaagtgaagcctttctctggacgctcaattgtaacgttgcaacatcactcctttccctaacatcactacttctcttttttgctttatttttcaccttagcaggacagttttaaattacctgtgttatgccttctccaacccacagtatggagagagatgccctttgcttgggagaagaagaggtaagtgaacaccagactttgcctcagacccaaacactgggcccaacacagtaaagtctagccctggacaggccatgattaccccagactttaggctggtccccacagacttgggcagtaggccagcccttgtagccccaatgtccaggccatccctgcagatgtagtctcccagccctgggccagtagccccagactccagacttccttcagcaccagatcatacctccaggcttgcacccctccaagacagcccctttgcttcaggacagccactgtacccccagactcagctttcaggccctctccatcacaagactagcacctttggaccccagtttaaggccaatacccacagacccagtatccagaccaactcagctccaggctggccttcacactcccaggctttgggtctgtcccagtgccacgttgacacccatggacctcagctccaggctggcccccatggccacaggtaccaggtcagcatccaaacattcagcctccaatacagccctcatgggtacagactccaggccatccctggtggccccagatttcaggctggcccattcaagctcaggcttcaggcccagaccaggctccaaccgagtccaaaaaaggctgacccacagagccccaggcttcaggcccgacccagaactaagctggcttcttcaaccccagattttgggcaactgtagcagaatacacattattttcaagtgcatacagaatattcaccaggatagatcatatgttaggccacaaaacaattcttaaccacttaagaagattgaaattacatcaattattttttccaaccacaatgaacatccttgtcttgtttctgatcttaaggggaaaaacttcagtccttcactattgagtacaatgtcagctgtgggtttttctttttgttgttgttgttttattgagtattttattatgtcaggaattgtgctaaatgctataaatgtatgatcgtatttcttctatgcaatgtatttttttcatttctttttttattatactttaagttctagggtacatgtgcacaacatgcaggtttgtcacatatgcatacatgtgccatgttggtgtgctgcgcccattaggtatatctcctaatgctatccctccccaccctccgacaggccccggtgtgtgatgttccatcctgtgtccaagtgttctcattgttcaatttccacctatgagtgagaacatgcggtgtttggttttttgtccttgccatactttcttgtttcctcacatgcctcagttttttttttttcttgaaaaccagatgttttgaatgttataatgtagaaactctggaaatctgattgattctcccagtcccctggtcttgttgttgctgcttattgtggttgttgttggtttagttaattttcttaactaattttgtaaagcctatatttttttggtatgtgtggcctctgaaatatttgttccattagctttagtcagttattgattttacagagattttattaaactcctggaagcaaaacaaagaaacaaactatgaaaacaaaaagctttcttagtttttgagggttggttctgtgttggggctctccttcattgcttagctatacagtttaaagttctgcctttgccttcattttctgcttgtgcagtgcctgaaatttagccagaattgagagcctagtcttctcagttcttttgtgagcacacatctagaaatgggtccatgcatagtcttctatagtcctcagaatacataaaatgttttgaagccattatttccctaagcatcccccaagtatctcagcctctttctccctgggattttttttttttttttttgagatggagttttgctcttgttgtccatgcccaggctagagtgcaatggcgcaatctcggctcaccacaacctctgcctcccaggttcaagcgattctcctgcctcagcctcccgagtagctgggattacaggcatgcaccaccacgcctggctaattttgtgtttttagtagagatggggtttctccatgttggtcaggctggtctcgaactcctgacttcaggtgacctgcccgcctcggcctcccaaactgctgggattacaggcatgagccaccgcgcctggcccttcctgggatttttccatttgtctattgcttttcccagatgttattccttgttctgtgtagctgtgactaatacatttgctttaaaattctttccacaaccagcaccagggaaggtgcctcagccctggggaagctctagtgcaggtgataaaaaggtaaaccattgaggtaatccttcagggaaccaccagatagatcaaactacacaatcacagttcattgaaaataaggtcaatatcgcttcctctggtaccagtaacctgcacctgcaatataagctgccatttttaagactattgatgggctgagggttggaggatggtctcaaggtaaccaaaaatgccacagaactctcactgaaatttaaattttttattcattaagtgttctcctggctgctgtaatttttgcttagattccagagttctgaaaaagttgcttctgacagttttgccagcctattcattgcttttatgaaagaatggagttctggaattccctactccaccatttccattaatgtgggtgtttacaaggcttttaaaaagtagataaaacaaagttcatatggaagggttcccatatccagcaatatggaagactaaccgttgtggagggccttgtaaaaagacaattccttttagcagtgtttgtaacaataaaacgtagaaacaatatttcagtcctttttcaagtcatggtaactattatgaactagtatgaaccagtggttgttgtgtgttatcgaatcttcacttttaaaaatgggtgtgtcaaagagtgggtggagataatttttaatatatttgactgcttgaccattagtatctaatggagatattgcacatcatccaaaggtactggactttaagccgactgtagtaactgtgtgttccatatgtgagaagagggatacatacatttatttgggtggtcagaggggcaaactatggcagataacacacttatataccactacttagatctaaccacatgaattacctctggacaatgagctgtaaatggaaatttttgggtgtggcttctgtgaaaactccttagagctgacttgtatattagatctgttgcctggagttccagcagacatattgtcaccatgagttaactttgagactggaagcctcacttgaaggatggcagagaagaaagattaggagttgaaatccctaatgaaattacggagctatcatcctaggttcattctgagtttcttatgtgagaaaaataaaaaccatatttctttctttcttttttttttattttggttttaaggagcggagagtttaataggcaagaaggaagggagaagacagaaggaagaaactcccccataccgagacagagggaggggggctccaaagccgaaagaggaggccccccaaaaaccatatttatttcattaaaaaaatttattttagtttcggatacatgtgaaggtttgttacataggtgaactcatgtcatgggaatttgctgtacagattatttcatcaccaaggtattaagctcagtacccagttgttatcttttctgctcctttccctcctccaaccctccaccctcaagaacaccccagtgtgtattgttcccttctttgtgttcatgagttctcatcatttagctcccgcttatatatgcgaacatgtagtattggatttctgttcctgtgttagtttgctaagaataatagcctgtagctccatccatgttcctgcaaaagacacgatctcattcttttctatggctacatactattccatggtatatatgtaccaccttttctttattcagtctgtcattgatgggcatttgggttgattccatgtctttgtcattgtgaatagtgctgcaatgaacattctcatgcacgtgtctttatggtagaatgatttatattcctctgggtatatatccagtaatgggattgctgggtcaaatggtagttctgctgttagctctttgaagaatcactacactatcttccacaatggttgcactagtttacactcccactgacagtgtataagtgtttgcttttctccacaaccttgccagcatctgctatttcttgactttttatttttatttttagccattctgacttgtgtgagatggtatatcattgtggttttgatttgcatttctccaatgatcactaatgagcttttttcatatgctaatttgccccatgtatgtctgttcatctgttcatgtcctttgcccacatttgaatgcgatttttttcttgtaaatttatttaagctccttatagacactggatattagacctttgttagatgcatagtttgtaaaaattttcttccattctgtaggttgtctgtttactctgttgattgtttcttttgctgtgtagaagctctttcatttaattaaatcccatttgtcaatttttgcttttgttgcaattgcttttgacatctttgtcatgaaatctttgcctgttcctatgtctaggatggcattgcctaggttgtcttctgggtttttgtagttttgggttttacacttaagtctttaatccatcttgatttttgtatatggtataaggaacgggtccagcttcaatcgtctgcatagggctagccagcccagcaccatttattgaacagggagtgctttccccattgcttttgtcagctttgtcaaaaatcacatggttgtaggtgtgcggccttattactgggctctctattatgtcccattggtctatgtgcctgtttttttctttctttctttctttttttcttttgagacagagtttcactctgttgcccaggctggagtgcaatgacgtgatcttggctcactgcaacctccatctctcaggttcaagcaattctcctgccttggtctcctgagtaggtgggattacaggcgtgtgtcaccaagcctggctaacttttgtatttttagtagagatggggtttcaccatgttggccaggctgatctggaacagctgacctcaggtgatccacctgcctcggcctccaaaagtgcagggattacaggtgttgtatcagtaccatgctgtgttttgcttactgtagccttgcagtatagttcgaagttggctaatgcgatacttccagctttgttatttttgcttagaattgccttggctattcgggctcttttttggtttcataagaattttaaaatagttttttctagttctgtgaagaatgtcattgttagtttgttagaaataacactgaatctttagattgctttgggcagtatggtcattttgttgatattgattcttcctatccatgagcatgggatatttttccatttgtttgtgtcttctcttatttctttgagcagtgttttgtaattctcattgtagatatccttcacctcctgagttagctgtattcccaggtattttatttttttgtgtgtggcaattgtgaatgggattgccttcccaattgggctctcagcttggctgatgttgatgtatagaaatgcaagtgatttttgtacattgattttgcatcctgaaactttgccaaagttgtttatcagctgaaggacctattgggttgagagtatggggttttctttgagaaaaattttttattgtgatataaaatgcacttataaaatgtccaccagaaggcatgtaattcttcactgctatataaatttattgggaatatgttattcattgtctaggtatgataatgccacctaaaacatactgtaaatgatgagttatgctctataacaaatgcatcactgattttcagcaatcataggtttaataataattagtttaagactataatcacatctatattctggaatgtccatttactttaatgtagtgtagtggaatttagagtataattgcacatagatggtacagaaaaacattcacttctaaattattttataccttcatgacaggtagtcttcctgactgaaaataactgcttcagctatggtctgcaacacagctccaggattcttaatgcaatagtttgggtgtatgtatgtctgtccatgtgtgctcccatggaacaacttatatctttaataaacaagtgcaacattattgtcaattattttgcatgtttaaatactatagtctgattatttgtaaacaaacaaaaccccacacaaatactctaaattctatataaaaaatctgtcaacccataattattctaatatgctttacttacttgaacacaaatttctgaaaggtacatatattaccttagataataaggtttagaaataagtgctttggccgggcgcagtggctcacacctgtaatcccagcactttgggagggcaaggcgggcgggtcacctgaggtcgggagttcacaaccagcctgaccaacatggagaaaccccgtctctactaaaaatacaaaattagccaggcatggtggcacatgcctgtaataccagctacttgggaggctgaggcatgagaatcacttgaaccctggaggcagaggttgcagtgagcggagatcgtgcgattgctctccagcctgggcaacaagagcaaaactccgtctcaaaaaaaaaaaaaatgagtgtttcaccctatgaaatgtgcatttctgataactgatttacgcagcataaagtttagatcaataaattacaaatcctggatccccacagctcatttagaaaatgcctcaaagttatggtttttgtagcaggtttaacagactaaacatgaagtattctagcttcctctatttcaagtatcaaagaaatatgaggctcaaaatctctctaggttgtaactgaaaatgcaaagcattagaagacagttaaatgtggtttgaaatacaatattaattgaaaggagattattaaggtgtttatctgtgttagcctgttaaatactaggactttaaagtaattttaaatctgaatatttgttcagaagtgacaaagaacacaatttgcctataaatgtatggttttggagaaaaaagtcaatcctgatttttaaaactctttcaacattttttatttccttttgaatgatattaatttaaatttcaatctgaacataaatgtttggcttcacagagccttagataatttactaaggctgtttaaagtctttcaatgtcatcagaaatcctgcagtatagaaaatatctggtacccttaaagtttcagagtgagctgatctgcaattttaatgctgtttaaaaaaaagtcaaatataaaagactgctgcaatataaagcactatttctaaaagttgcagagatgatcctatagtctgacagagttagcacagctactcagaataagcaacttctggccttttccgaggcacactaagtttccagcttagaaaatactctagcctggtctttaacatattcattaagtgataagaatattttaaggtctttctgtcctacaagaaagtagtaagtttatccttcgagacatcagactttctagaactggctcaattgtataaaattttaacaagtatgtgaaagtgtagaatcaacactataaaaacagtgtgacaaaattaaacattatgttgaactcttttctagctttaagtcaaaaatagaaatcatgactcttatgtaacattaatttaaaaagtacatagaagtgacaagtgctattttccaaaaagtacaattttttccctactttatatcaacatggaatgatttcagttctcctgtattgaaagctggacttttaaaaaactagtattgctatgtttaatgtgatgacttgaatcagtagtagcttcattttccgctgggcccctaattagtcttcgaattcttctttttcctgcatgctgcttgggatgtacttcttcttcacaaaggaagtctgaagtcaactaatcctcattgtctatctcaatctttctaattacatccattacaacatccatagttgtctttctacaatttctagcagagggctcttgcagctagaatacagcatccgttctcttatactgcatgtgtatctgggcattgaatagataaaaactatggactctaaatagtctccttcatgggaatgtttatacagaaagaaatggtaacgagctgaatccttgggaatcctctttggcaaatcttttagttctgtatttgttgtgttggccaaaattataatttcattttttatgtttatttccaactgcacatagttcagctgttatttattttttccaaagcctgaaaagcttctcgagaaataggaaatgctactccttgtagtgtttgatgcttagcgtccacacccacgtcagtctgtacctcattgattttaatgtcataattcttcctcagctgcagtcagtggggcaggggaagattgtgagagcaaacattttttatatccatgtaatgatacatcttcctttactgttccaaatacttcatctttaacgtggccacctccagattccttttccagagttgctcttgttgctgcatataaccttttttgacggacatgagaatgatctggaaaccatgcaatgaatatccattcatatccctgggcattctgagaatctaacctgaataatatatagcacagttgtttgtcctccaacaggggtaaaacaaaggaatcataatcgttatcccaggaatctgaaggctgactatatatgatccaatcataagttgcccattttcaatagatattttcagaggtctgtactttccatttctggctctggcaagatctctttaacatcttcacttgcttggatgcaggtctggtgggacgtggcggcggccactagctcctggctccgatgctgagtgcagccgagtatggggttttctagatatggaatcatgtcgtctgcaaacagggatagtttgactttctatgttcctatttagatgccctttatttctttctcttgcctcactgctctggctagaacttccaatactattttaaataagagtggtaagaagggcatccttgtcctgtgcctcttttaaagtggaatgcttccagcttttgcctattcagtatgaagctaatagaaaatcagacggatttgacaagatgattcacaggagaacaaaaccaaatgatcaaacaacataggtaaagatgcttaaatgtatctatcattcaaggaaatacaagttaagtatcaatgagatgtcactacacctgttatattggcacagatgtaaaaagagtgctaatgcctagtattacagatatgttgggaaagagtatgctgaataaaacagatatttaaaaaaatggggtcggacggatgtcaggagcgctgccgccgccgcaggaccttctccattcccgcccgcagccccgcggccatgcgacagcgacccagccacccccggagcgcagtcctcgaaggatgaaattgaagataattcaaatgaccggacccaggcatccaaaaagaggcgaatgggctcaggagatggttctaggagctgtgaaacttcaagtcaagatcttggctttagttactatccagcataaaatttgatagagtacaaatggccacctgatgaaacaggagaatactatatgcttcaagaacaagtcagttaatatttgggtgtgacctcctttaaaaggaaatatccagatttagagagacgagatttgtctcacaaggagaaactctacctgagagagccaaatgtcattactgaaactcaatgcactctaggtttaactgggcagtgatgaagtgattgttttaacgataaaggaatatccagccaaacatgctgagtattctgttattctacaagaaaaagaacgtcaacgaattacagaccattacaaagagtattcccaaatgtaacaacagaatactcagaaagttgaagccagtaaagtgcctgagtatattaagaaagctgcctgtaatcccagcactttgggaggccgagacgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcagagcttgcagtgagccaagatcgcgccactgcactccagcctgggcgacagagcgagactccgtctcaaaacaaacaaacaaacaaacaaacaaacaaacaaacaaataaaaaagctgccaaaaaaagcagcaacttaaaccgggaacgcatggaagaaagaagagcttattttgacttgcagacacgttatccaggtgcctcaagggaagtaggaagttttgccaacagggcgaacaaaggtcagttcttacccagtggctctcatccccggacagttccaggaatattataagaggtactcaccagatgagctgtggtatctgccattaaacacagccctgtacgaggccactctggatcctgagctccctgctctagacagtgacggtgattcagatgacggcgaagatggttgaggtgatgagaagcggaaaaataaaggcacttcggacagctcctctggcaaggtatctgaaggggaaagctctcctgacagccaggaggactctttccagggaagacagaaatcaaaagacaaagctgccactccaagaaaagatgctcccaaacgttctgtactgtccaactcagttcctgggtacaagcccaaagtcattccaaatgctatatgtggaatttgtctgaagggtaaggagtccaacaagaaaggaaaggctgaatcacttatacactgctcccagtgtgagaatagtggccatccttcttgcctggatataaagaaaataaaggactcaaatattaccactacacaaaaccaccaaactgtaatgataaatgacaagagagagagaaaaaaaacaaagaatatacaaaacaaccagaaaaaaataacaaaatgacagaaataagtcttcacatgtaaacataaacagattaaatattccacttaaaagacatacactggatgaatagacttaaaaaacataatccaactacatagtacttacaagagactcacctcactagtaaagacacatatagactgaaatgggttgataaagatatttcacacaaacggaaaccaaaagtgagcaggattagctataatcatataagacaaaacagacattaaatcaaaaaaagtgaaaaaaggactaaaactatcattatataatgacagatcaacccagcaaaaaagatataacaatcctaaatatatatgcacccaatactggagcatccagattcataaagcaaacattactagatctaaaggtagagacagactgcagtgcaataataggaaggaactttaacatcccactgtcaacattagatagataatctagacagaaaatcaacaaataaacattagacttaaactggactttagaccaaatgaaccaaacagacatttacagaacattctatccaacaactacagaatatacattcatcagcacatggaatattctccaggatggaccatatgtcaggccacaaaatgtctcaataaatttaacacaatgaaaatcataccaaggatattctcaggccacaatgaaatcaaatcaactataaataaacaccaagaggaactttagaaactgcataaatacataaaaattaaccaacatgctcctgaacaaccaatggtcaataaagaatttaagaagaaaaaaaattcttgaaacaaatgaaaattgaaacataacatacataaacctgtgggatacagcaaaagcagcactaagaggcaagcttatagcaataaatgcctacatgaaaaaagtaggaaaatgacaaattaacaatctaataatgtatgtgaagctgctagaaaagcaagaacaaaccaaataccaaattagcagaaaaaggaagtaataaagaacagaactaaatgaaatacagactaaaaaatacaaagcatcatgattgaaaaagttggtttttgttaaattgataaactgccagctagactaaccaaaaaagtagaagacccaaacaaacaaattagaaatgaaaaaggacacattaagtcatatatgtaagaaatacaaaagattaccagagaccattatgtacaactgtatgctgacaaactgataaacctagaggaaatggataagttccaggaaacatacaatgtgctgagactgaattgggaagaaatagaaaacatgaacagaccaataatgagtagcaagattgagtcagtaataaaaaagtctcccaatgaagaaaagcacaggactggacaaattcactgacaaattctaccagaagaactaataccaattctcctgaaactattctaaaaaatggaagaggagagaactctccttaactcattctatgaggccagcaccaccctgatacaaaaaccagacaagaacacacacatagaagaaaactacaggccaatatttctgatgaacatagatacaaaaactcttgacaaaatactagcaaactgaatccaatagcatatcagaaagataatacaccatgatcaagtgggatttataccagtgatacaagaatggttcaacatgtgcaaatcaataacctcaatatatgacatccatagaataaaggacaaaaaacatatcatcatctcaatagatacagaaaaagcatttgataaaattcaacaccccttcatgataaaacctctcaacaaatggggcatagaaggaaaatatgtcaaaataataaaggctatatatgacaaacccacagctgatatcatgctgaatagggaaaaattgaaagcctttcctccaagaaatggaaaaaaacaagaatgcccactttcaccactcctattcaacatagtattggaagtcctaggtatggcaatcaggcaagagaaagaaataaaaggcatccaaattgggaaaaaggaagtaaaattgtccctttttactggtgccatgatcttgtatctagtaaaacctaaaaactccaccaaaaaattcttagatttgataagtaaattcagtaaagttccaggttaaaaacatcaacactaaaaaatatgtagcatttctatacaccaataatgatctacccacaaaagaaatgaagatggcaattccatttacaatagctaaaaattaaaatatctaggaataattttaatcaaggaggtggaagatctttacaatgaaaactacaaaatgctaatgaaaggaattgaaaatgataaaaatatatgggaaaacatctcatgctcatggatcagaagaatgaatattattaaaattgtgattttcccaaagtaacctacagattcaatgcaatccctgtcaaaataccaatgtcatttttcacagaattacaaaaaaagaatactaaaattcacatgtaaccaaaaaagattccatatagccaaagcaattctgagcaaaaagaacaaagctagaggcatcacattacctgactttgaaatatattacaaggctatagtaaccaaaatagcatgttatggtataaaaatagacacacagagcaatggtcagaatagagaacctagaaataaattcacatatttactgccagctgatctttgacaaagttcacaagaacattggggaaaggacacctttttcaattaatggtactgggaaaattggacagccatatgcagaagaatgaaacttgatccttatctctcactgtatacaaaaatcaactcaaaatggactgaagacttaaacataatactcaaaactataaaaataataagagaaaacctagggaaaattcttctggacattgttctagacaaataatttatgattgagatgtcaaaagcacaggcaatagaaacaaaaatagacaaataggactcaagtaaactaaaaagcttctgcacagcaaaagaaatgagtgaagagacaaccttttgaatgagaggaaatgtttgcaaacttcaacaggggactaatatccagaatatacaaggaaatcaaacaactcaacaataaaaaaaatctcataaaatatgggcaaagggcatggccaaaatgtacataaagaaatgctcaactttactaatcaacagagaaatgcaaaccaaaaccaaaatgagatatcatctcacctcagtcagaattgctattattaaaaagacaaaaaaaaattaacagacgttggcaaggatgtggagaaaaaggaactcttatacactgtttttgggagtataaatatagccactatggaaaacagcatggagatttctgaaaaaaccaaaagtagcactaccataagatccaaaaatctcactaattggcatttatccaaagcacgagaaatcagtatgtcaaagggatacctgcactctcatgtttattattgcattattcacaatagacaaggtatggaatcgatctaagtgtccatcaacagataaatggataaagaaagtgtggtatacatacacaatgaaatagtattcagccattaaagagaatgaaatcctgtcatttggaacaacatggatggaactggagttgttatgtcaagtgaaataagccaggcacaaaaagacaaaaatagcatgttctcacttatatgtgggagttaaaaaagttgatcacatgaagatagagaatggaaagagagataacagagactggggagggtgattgggaggagaagggaagatgaagagaagtgtgttaaaaagtacacacataaataagatagaaggaataaattcaatgtttgatagaagagcagggtgactatagttacaaaaatgtattgtatttgggttatggacaccgtagataccttgactttatcactatgcattacatacacataatagaatttcatatgtatcccataatttgtactgataaaaaaatttaaaagaaagtgaaccatcaggccaggcgcagtggctcacgcctgtaatcccagcactttgggaggccgaggccggtggatcacaaggtcaggagattgagaccatcctggctaacacggtgaaacctcatctctactaaaattacaaaaaaaaaaaaaaaaaattagccgggcgtggtggcgggcatctgtagtcccagctactcgggaggctgaggcaggagaatggcgtgaacccgagacccgagaggcggagcttgcagtgagccaacatgtgccactgccctccagcctgggcgacagagcgagactccgtctcaaaaaaaaaaaaaaaaaaaaaaaaaaaaaaaaaaaaaaaagaagaaggtgaaccatcagagagacattctcctgcaggttttagaggaagagaacaatcagccatgttgcgaaatgcctatacagaggggcagcctctagtaattgaatgccaacccaaccccaacaaacagctacccaataacctaagacctcagtcatatagctgcaaggaactgaattctgccaaaaacttgaatgaagatggaagagtcacctgggccccatatgataactgtgttcccgaccaacaccttgaatgccactttttgataccctcagcagaggaccttagcaggctatgcccagacaactgaccaatggaagctgtgagataataaatagctgttgttttaagatactaagtttgtggtaatttgttacacagcaatagaaaattaatacagcatgcttcttgtttctagacctatcctgggtagacagagatgtgcggttgtcattcaagtgtaggcagtacagttctggcctctggttaactgcttgaagtctatgtcctggccactagccctcgtgttgggtatgttctgtcatttcgtcagtggtgttaaggaccagtcatgaccaatccttatgaattacatagtgttagtatcccattccctcactcccatctcactatatgttcctactctatttctagagcacagagaacttaccttcttgtgttatgtatgttatgcagcttttaaaaattatttgaaatattacacatatcatctttttgtatttgaagttggaggggtatgtttatgcatgtgtgtcatttgacatgtaggcccagaaatccaaaagtacttaaattggtaagaatactaaatctgcaataaacaagccagtaaaatagattatcttcagcaaaatagtatcttgtaaatgctgtaccttggaggagccagggtttgttctaaaaactcctcaattttaatgaagtctgttttcaactccttgttatacaccaggaacggaggattggtacctggggctaagtcctttagttcttcaggctttctatgattattaaaaataagcagagttaggtctctagataaagtacacattaaataaacaccaatattttattggtatctaccaatctcaattcctagaatttaacatgtcctgatttctcttacctggtcatgtcaacagttgtcacattaaatttaactcctttaagccagaggatcatgaaaaggcgttggcaaaagggacagtttccaatactctctccatcacttccagcctattaagataaagagagacctcagttcatttgtttgttcaataagtatgtatttagttcctaataggaaatgagccagttgctagagacaaacatggacattcttaatctcatgtactccatcatctatggacagagagatatagggaagcaaataatctcattatatgtaaagttacaactgtgatgggtacataataataataataaattttatatattatcagaatttatataattttcctattgatagacatttaagatattccaaaattattactactctaagcacttcagaaacaaacatttctgggcatatagcttcttccacttctgagattatatctttaaggttaatctttaaaatgaaaatggtcagtaaaatgtatgcacatttcccattttgatagatcttaccaaatttcctttcttttttttttattattatactttaagttttagggtacatgtgcacattgtgcaggttagttacatatgtatacatgtgccatgctggtgcgctgcacccactaactcgtcatctagcattaggtatatctcctgatgttatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcctcattttctatggctgcatagtattccatggtgtatatatgccacattttctgaatccagtctatcattgttggacatttgggttggttccaagtctttgctattgtgaataatgccgcaataaacatacgtgtgcatgtgtctttatagcagcatgatttatagttctttgggtatatacccagcaatgggatggctgggtcaaatggtatttccagttctagatccctgaggaatcgccacactgacttccacaatggttgaactagtttacagtcccaccaacagtgtaaaagtgttcctatttctctacatcctctccagcacctgttgtttcctgactttttaatgattgccattctaactggagtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgttttcctcttgtaaatttgtttgagttcattgtagattctggatattagccctttgtcagatgagtaggttgcgaaaattttctcccattttgtaggttgcctgttgactctgatggtagtttcttttgctgtgcagaagctctttagttgaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttaataaatagggaatcctttccccattgcttgtttttctcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtaacctcttttatttccttgagcagtggtttgtagttctccttgaagaggtccttcacatcccttgtaagttggattcctaggtatttcattctctttgaagtaattgtgaatgggagttcactcatgatttggctctctgtttgtctgttgttggtgtataagaatgcctgtgatttttgcacattgattttgtatcccgagactttgctgaagttgcttatcagcttaaggagattttgggctgagacaatggggttttctagatctacaatcatgtcgtctgcacacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttactgaggatttttgcatcaatgttcatcaaggatattggtctaaaattctctttttttgttgtgtctctgcctggctttggtatcagaatgatgctggcctcataaaatgagttagggaggattccctctttttctattgattggaagagtttcagaaggaatggtaccagttcctccttgtacctctggtagaattcggctgtgaatccatctggtcctggactctttttggttggtaagctattgattatttccacaatttcagctcctgttattggtctattcagagattcaacttcttcctggtttagtcttgggagagtgtatgtgtccaggaatttatccatttcgtctagattttctagtttatttgcgtagaggtgtttgtagtattctctgatggtagtttgtatttctgtggaatcagtggtgatatcccctttatcattttttattgcgtctatttgattcttctctctttttttctttattagtcttgctagcggtctatcaattttgttgaccctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttgcatttgctgaggagagctttacttcccagtatgtggtcaattttggaataggtgtggtgtggtgctgaaaaaaatgtatattctgttgatttggggtggagagttctgtagatgtctattaggtccccttggtgcagagccgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatatttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgtgtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcactcatgaagcttagtttggctggatatgaaattctgggttgaaaattcttttctttaagaatgttgaatattggcccccactctcttctggcttgtagggtttctgccgacagatccgctgttagtctgatgggcttccctttgagggtaacccgacctttctctctggctgcccttaacattttttccttcatttcaactttggtgaatctgacaattatgtgtcttggagttgctcttttcgaggagtatctttgtggcgttctctgtatttcctgaatctgaacgttggcctgccttgctatattggggaagttctcctggataatatcccgcagagtgttttccaacttggttccattctccccgtcactttcaggtacaccaatcagacgtagatttggtcttttcacatagtcccatatttcttggaggctttgctcatttctttttattcttttttctgtaaacttcccttctcgcttcatttcattcatttcatcttccattgctgataccctttcttccagttcatcgcttcggctcctgagccttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggaactgcgttcctttggaggaggagaggcgctctgctttttagagtttccagtttttctgttctgttttttccccatctttgtggttttatctactttggtctttgatgatggtgatgtacagatgggtttttggtggggatgtcctttctgtttgttagttttccttctaacagagaggaccctcagctgcaggtctgtttgagtaccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtcggcagaggttactgctgtctttttgtttgtctatgccctgcccccagaggtggagcctacagaggcaggcagacctctttgagctgtggtgggctccacccagttcgagcttctgggctgctttgtttacctaatcaagcctgggcaatggcgggcgcccctcccccagcctcgctgccaccttgcagtttgatctcagactgctgtgctagcaatcagcgagactccgtgggcgtgggaccctccgagccaggtgcgggatatgtggtgcgccgttttttaagcccgccggaaaagcgcagtattcgggtgggagtgatccgattttccaggtgccatctgtcacccctttctttgactcagaaagggaactccctgaccccttgctcttcccaagtgaggcaatgcctcgccctgcttcggctcgcgcacggtgcacgcacccactgacctgcgcccactgtctggcactccctagtgagatgaacccggtacctcagatggaaatgcagaaatcacccgtcttctgcgtcgctcatcctgggagctgtagaccggagctgttcctattcggccatcttggctcctccctccaccaaatttcctttctgaaaggtgcctttccatatggccattggccatttccttattttgtgaattgtttgtttatgacagtttttaatttttttatgaaggtaatgactttttcttattgtttggaaaaattatttgtattttaaagacattaactctttgtgatatatgttacatgtaattttaaaaacatggattatgtaaaatttaaatttacatgagatctaccatgctttttctctacgtggtctggcttttctgatctgcttatatacatcaagattacaaaaaacatatttccttactttatttttatattttgatttaccataaggattttctatcacgttttcttctagtaccatcatggtttaatttttgcatttgtttcatttatttggattttgttttggtgtaagaagtgtatgaggacttctttagtatttttaaatttttacaaatagttaatagtcttatgcctttcattaaataaatccatctgatatggtttggatatttgtcccctccaaatctcatgttgaaatgtaatctccaatgttggaggtggggcctggtaggaggtgattggatcctgggggcggatccctcattaatggtttagcaccatcatcttgttaataagtttgttcctgctcagttagttccctcgagatctggttgttaaaagtatgtggcacctccccccttgctctcttgttcccactttcagcatggagacacctgctccctcttcactttccaccatgattgtaagcttcctaaggccctcaccagaatcagatgccagcaccatgcttcttgtaatatctgcagaactatgagtcaattaaactttttttctttataatttacccaggctcagattttttttatagtattgcaaacacagcctgatacatcattgtattaggtcactcttgcattactctaaagaaatacttgagactggataatttataagaaaagaggtttaattggctcacagttctgctggctgtacaaacatggcaccagcatctgctcagcttctggggaggcctcagggaaattttactcatagcagaaattgaactgggagcagacacttcacatggcgaaagcaggagtgagagagagagagagagagtgggggatgagatgccacactttacaacaaccagatctcatgagaactcactcactatcatgagggcagcactaagccatgagaggtttgccctcatgatccaaacactttccaccatgccccacctccagaattgggaattaaaatttaacatgagatttgggcaaggagaaatatctaaactatatcagccatcattttttctactgatggaaaacactttttctgctttgaaattttatatgcacttgagtttattggtggaccctctttcttcacttactcatttacttacccaatgaatattcactgaacaaattatgtgtgtaacatataccagacatatacatatatatatacacaccagatattaaaataaaaatattcccccaaattaactctcagttttaaacagagataaattatttgaagaaaggaagtgcattttatgagtgtataacagagaaactctgagaaatctatatggggtctgtcagggaaggccttccctgaggaagtagcatttaaactaagttcaaaggataagtaacagttaattagatgaatgggcacgaagagggcattctaaacagggaataacatgtgcaaaggtcttgcaataggcttgagcatggcatgtataaagaactgaaagaaggtcaatgtgactggaattcagaggagggagagaagagaaaaattcaataagctgggatagagcaaaaataaaatgtcctgcttttcaaaagaattattaagaaaataaaaaagtcctgtatctataacatataaaaatacaaataaagaacacaactcaacaactaactacccaactttaaaaatgggcaagagacgccaagtgtggtggctcatgcctgtaatcctagcactttgggaggctgaggcaggcagatcacttgaggtcaggggttcgagaccagcctgagcaacatgatgaaaccccatctctactaaaaattagctgggcatggtggtgggctcctgtaatcccagctacttggcaggctgaggcaggagaattgcttgaaccctggaggcagaggttgcagtgagccaagatcatgccactctactccagcatgggcaacagagtgagactctgtcttaaaataaattgggcaaaagagaggagaggtggagcaggaaagccaaattaaagccttcccaagaacgatgggtacaaacaggcccagactgtgaagattacaataaatacctaactctttaatgcccagatgtagataaacatccataagaatcaagaccatccaggaaaacatgacctcaccaaatgaactaaataaggcactagggaccaatcctggagcaacagagatacgtgacatttcagacaaagattcaaaataactgttttgaggaaactaaaaaaaaattgagataacacagagaattctatcaggtaaacctaacaaagagattgaaataacttaaaagaatcgagtggaaattctggagttgaaaaatgtaactgacataccgaaaaatgcatcaaagtcttttaatagtagaattgatcaagcagaagaaagaattaatgagcttgaaggcaggctattttaaaacacacagacgagaaaaaagaaaaaaatcataaaaaagaataaagcatgcctatgaaatctacaaaatagcttcaaaagggcaaatctaagagttattggccttaaagaggaggtagagaaagagataggatagaaagtttattcaagggatatcaacagagaacttccaaaacctagagaaagacattgatatgcaagtacgagaatgtcatagaacaccaagtagatttaacccaaaaaagactatctcagggcatttaacgtccaactctcaaaggtcaaggataaagaaaggatcttaaagcagcaagagaaaagaaactaataacatacaatggcacttcagtgcgtctggaagcagacttttcagtggcaatcttacaggtcaggagagagtggcatgacacagtgaaggtgttgaaagaaaaacacttttaccctagaatagtatatccagcaaaaacatccttcaaacatggagaaataaaaatcttcccagacaaatgaaagctgagggctttttatcaacaccagatataccctacaagaaatgctaaagggagtacttcaatcagaaaaaaaataaggttaatgacaaataagtaatcaccagaaggcataaaactcacagaaaaacacagaatattataatactgtaactgtggtttgtaaactactcttaagtagaaagactaaatgatgaaccaatcaaaaataataactacaacaatgttttgagacatagacagtacaataagatacaagtaaaaaaaaccctctgtctctactaaaaatataaacaattatccaggcatggtggcacgtgcctgtagtcccagctactcaggagactgaggtaggaggatcacctgagcttgggaagtcaaggttgaagggagctaagattgtgccactgcactccagcctgggcaacatgagtgagcccctgtctcaaaaataaaaaaataaaaataactcacaccaattctactcaaactattctgaaaattataggtggagaaaatacttctaatatcattctacaaggccagtattaccatgataccaaaaccaaagacacatcaaaaaagaaaactataggccaatatcactgataaatatttgtattagtctgtttccatgctgctgataaagacatacatgagactgagcaatttacaaaaaaaataaaaataaaaagaggtttaatggactcacagttccacgtggctgggaaggcctcacaatcatggaagaaggtgaaaggcacatctcacatggcagcagacaagagaagagaatgagagccaagtgaaaggggcccttataaagccatcagatctcatgagacttactaccatgagaacagtatgggggaaactgtccccatgattcaattatctcccactgggtccctcccacaacatgagggaattatgggtgttacaattcaagatgaaatttgggtgggggcacagccaaaccatatcattctgcccctggcccctcccaaatctcatgtcttcacatttcaaaaccaattatgccttcccaacagtccctcaaagtcttaactcattttagcatttactcaaaagtccacaatccaaagtctcatctgagacaatgcaagtcccttccatctatgaaccagtaaaatcaaaagcaagttagttatttcctagatacaatggaggggtacagacattgggtaaacacagtcattccaaatgggagaaattggccaaaacaaaggggatacaggccctatgcaagtctggaatccagcagggcagtcagatcttaaaactccaaaatgatctccttagacttcatgtcttgcatctgggtcatgctgatgcttgagagatgggttcccattgtcttgggtttataaggtttagcttaggtgtcttcttgtttattttgggaatggaaatcaacatttatagtgactgtatatagtgccaggtcaggaagcctggagaaataacctataggaatccacaaggtggcttgtttatgtatgtttctgaagccaatttccccagtgagatcactgaatggattggctatgccctggccacttggtccatcctgacacttgcatttgcatttttctcaccttgtttccttgggcagctctgcccctgtggctttgcagggtacagcctctctcctggttgttttcacaggctggcattgagtgtctgtggcttttccaggcacatggtgcaaactgtcagtggatctaccattctggggtctggaggatggtggccctcttctcacagctacactaggcagcaccccatggggactctgtgtgggggctccaaccccacatttcccttccatactgccccagcagaggttctccatgagggccccaccccgaagcaaactctgcctggacatccaggtatttccatacattctctgaaatctaggcacaggttcccaaacctcaattcttgacttctgtgcactgcaggctcaacaccacatggaagctgccaaagcttggggcttgcatgctctgtagccacagcctgagctatactttggccgcttctagtcatgcctggagtggctgggatgcagggcaccaagtccctagactgcaaacagcagagggaccctgcgcccagcccacagaatcatttttcattcttaggtctcagggcctgtggtggaaggggctgccacaaaagtctctgacatgccctggagacattttccccattgtcttggtgattaacattctgctccttgttacttatgcaaatttctgtagctggcttgaatttctcctcagaaaatgggattttcttttctatcacactgtcaggctgcaaattttctgaaattttatgctgtgtttcctttttaaaagtgaatgcttttaacagtacccaagtcacctcttgaatgctttgctgcttagaaatttcttctgccagataccctaaatcatctctctcaagttcaaacttccacaaatctctagggcagggacaaaatgctgccagtctctttgctaaaacataacaagtgtcacctttgctccggttcccagcaagttcctcatctccatctgagaccacctcagcctgtattttattgtccatatcatcagcattttggtcaaagccattcaacaagtctctaggaagttcctagctttcccacatttttctgtcttcttctgagccctcccatgtgttccaacctctgcctattacccagttccaaagttgcttccacatttttgagtatcttttaagtagcaccctattcttggtaccaatttactgtattagtccattttcatgctgctgataaagacatacccgacactgggcaatttacaaaagaaagaggtttaatggactcatagttccttgtggctggggaggcctcaaaatcatggcagaaggtgaaaggcacatctcacatggcagcagacaagagaagagaatgagagccaagggaaagcggtttccccttataaaactatcagatcttgtgagacttattcactaccatgagaacagtatgggggaaactgtgcccatgattcaattatctcccactgggtccctcccacaacatgagggaattatgggagctacaattcaagatgaaatttgggtggggacacagccaaaccatatgattattgttgcaaaaattgtcaataaaatactagcaaactgaattcaacaacatattaaaatgatcattcattctgtaggttgtctgtttactgtgttgatagtttcttttgctgtgtaggagctcttaagtttaattagaccccatttgtcaatttttccttttgttgcagttgtttttggtgtcttcatcatgaaatctttgcctgttcctatgtccagaatggtattgcctaggttttcttccagggtttttgcacttttgcattttgcatttcagtacttcacccatcttgagtttatttttgtatatggtgtaggaaaggggtccattttaaacctcctgcatagggctagccaattatcccagcaccatttattgaataaggagtcttttccccaatgcttgtttttgtcaggcttgtcaaagatcagattgttgtaggtgtgtggccttatttttgggctctctattctgttccattgttctatgtgtctgtttctgtgccagtaccatgctgttttggtaaccatagctctgtagtatagttttgagtgaggtaaggtgattcctccagctttgttctttttgcttaggattgctttgactatttgggctctttttgtgattccatatgaattttaaaatagtcttttctggttctgtgaagaatgtcattggtagtttgataggaatagcattgaatctatagattgctttgggcagtatggccattttaatgatatttatttttcctatccatgaacatggaatgtttttccatatgcatctgatgaaggcctaatatccagcatctataagaaacttaaacaaatttacaagaaaaagcctatgaaaaagtgggcaaataacatgaatagacacttttcaaaagaagacatgcatgtggccaatgagcgtatgaaaaaaaagttcaacacccctgataattagagaaattcaaatcaaaaccagaatgagacaccatctcacgcagtcagaatggctatgattaaaaagtcaaaaataggctgggcaccatggctcatgcctgcaatcctagcactttgggatgccacggagggaggatggatcacttgagcccaggagttctagaccagcccaggatacatagcaaaatgccacctctctatataaataaggcaaaaaaaaaaaaaaaaaacaaaactactgtcaaagttgcagggaaaaaggaacacagacactgttaagtgggagtctaaattagttcaactattgtggaaagcagtgtgacattttcttaaagacctaaaaatagaactaccattttacccagcaatcctattactgggtatctacccaaagagatataaattattttatcataaagatgcatgcacacatgctcactgcagcactattcacaatagcaaaaacatggaatcaacctaaatgcccatcaatggtagactggataaagacaatgtggtacatatacacaactgaatatgatgcagccataaaaaagaataagataattaagatggcagataggaggcagcactagcttgcagctcccacttggacagacagagaggtgtggaggctcacatcatgatcttttgctccaagaagtaccacagcaacattccagggaagctgagataatccacagaccctttgaaggaactggagcactgctgcatgctccctgagatgctgaaaaactgtgagtctccttgctttttagctgggaggctggtggtctggggcaagttctcagccttgatcaccagattcccagaaatagactcggtgctgttgagggggcacagtgggagtaagactggcctttaggactgcaggctgcatgggtgcgggatgagcctgtgactgccagctttcccctacttccttggtgatctgtatgactcagcagaggcagctattatccccgtgggaacataactccattggcctgggaaccacacccccatcccctacagcagccacagcaagctacactcaaggagagtctgagctcagacatgcctaaccctgcccccacttggtggtctttctctacccaccctggttgcaaggacaagggacataatctcttgggagctctatggctctgcccaccacccgagaaacctgaatacttaaccaggtgaccctagggaaagtttgcttcctccctagactactacaactgatgtgctcttgaaagcaccacctcctggctggaggccaaccaatacaaatccagcacattaaataaaaatacaaccaaagactctcacagaatccacttcactcccctgctatctctaccagagcaggtgctggtatccatggccaaaagacatgaagatgggtcatatcacaggactctttgcagatactctccagtaccagcctgaagccagtagctccgctaggtggctagacctagaagagcaaaaacaatcaccgcagttcggctctcaggaagcccgaattctagaggaagtgtgagaacaacaatcaagggaccaccccgtgggagaaaagaatttgaacagcccctcccagatcttccctctgacatagtctaagcaagtgagaaataactagaaaatcaattctggtaatacaacaaaacaaggtaatttaacactcccaaaagatcacaccagctcacaagcaatggatccaaaccaagataaaatacctgaattgccagaaaaagaattcagaaggtagattattaagctaatcaaggagacatcagagaaaggtgaactccaacttaaagaaatcataaacatgatacaggatatgaaaggaaaaatcttcaatgatatgaaagcaaaaatcttcaatgaaatagatagcataaataaaaaacaaccacaacttctggaaattaaggacacacttatagaaatgcaaaatgcactggaaagtctcagcagtagaatcaaacaagcaggagaaagaacttcagagcttgaagataaggctttcaaattaactgaatccctcaaagacaaagaaaaaaataattaaaaaacaaaaaaagtgaacaaagcctccaaaaagcttggaactatgttaaacacccaaacctaagactaattgatgttcccaaggaagaggagaaatctaaaagtctgaaaaccatatttgagggaataatcaaggaaaacttctccagcctttagatatctaggcatccaaataaaataagctcaaagaacacctggaaaatttatcacaaaaagataattgcctaggcacatagtcatcaggttatctaaaatcaagacaaacaaaataatcttaagagctatgaggaaaaagcatcaggtaacctataaaggaaaacctatcagagtaacagcaggtttctcagcagaaaccctacaagctaaaaggaattggggtcctatttttagcctccttaaacaaaacaattatcacccaagaattttgtatccagtgaaactaagcttcataaatgaagaaaagatacagtcttttacagacaaacaaatgctgggagaattcgccactaccaagctggcaatacaagaactgctaaaaggagctctaaattttgaaacaaatccttgaaatacaccaaaatggaacctacttaaagcacaaatctcacaggatctatataacaataacacaatgaaaaaaaaaccaaggtattgaggcaacaaatagcatgatgaatagaatagtacctcacatctcagtactaacattgaatgtaaatggcctaaatgcctcacttaaaagatatagaatccattctacaatggataagaattcaccaaacaagtttctgctgtcttcaggagactcacctaacacataaggactcaggtaaacttaaggtaaaggaaaaagatattccatgcaaatggacaccaaaagtgagcagaagtagctattcttatatcagacaaaacaaactttaaagcaatagcagttaaaaaagacaaacagagacattaaagaatgataaaaggactagtccaacaggaaaatatcacaatcctaaatatatatgcacctaacaccagagctcctgaatttatagaacaattactactagacctaagaaatgagatagatggtaacacaataatagtgggggactttaagactctactgacagcactagacaggtcatcaaaaaagaaagtcaacaaataaaccatcaacttaaactataccctaaaacaaatggacttaacagatatttacagaacattcttcccaacaactgcagaatatacattctatttatcaacacatggaacattctccaagatagaccacatgataaggcacaaaacaagtctcagtaaatttaagaaaatcaaaattatatcaagtattctctcagaacacagtggaataaaattagaaataaactccataaggaatcctcaaaaccacacaaatacctgaaaattaaataacctcctgaatgattgttgggtcaaaatgaaatgaagatggaaatcaaaaattgtttgaactgaacgataacagtgacacaacttatcaaaacctctgggatacagcaaaagtggctgtatttgtcagggttctctagagggacagaactaacaggatatatattatatatatcctattagtttattaagtattaactaacatgatcacaaggtcccacaataggctgtctgtaagctgaggagcaaggagaaccaggccaagtcccaaaactgaagaacatggagtccaatgtttgagggtaggaagtatccagcacgagagaaagatgtaggctgggaggctaagtcagtctcatctttttatatttttctgcctactttatattctagccatgctggcagctaataagatgctgcccaatcagattaagggtgggtgtgcctttcccagcccactgactcaaatgttaatctcctttgggaacaccctcacagacacacccaggatcaatactttgcatccttcaatccaatcaagttgacactcagtattaaccatcagagtggtgctaaaaggaaagctcatagtattaaatgcctacatcaaaaagtctgaaagagcacaaatacacaatctgaggtcacacctcacagaactgaagaaacaaaagcaatccaaacccaaacccagcagaagaaaagaaataaagatcagagcagaactaagtgaaattgaaacaaacaaacaagacacaaaagataagtgaaacaaaagcttgttattggaaaagataaataaaattgatagacagttagtgagattaaccaagaagagagaagatccaaataaactcaattagaaatgaaatgagagatattactactgatacgacagaaatacaaaaaaattatttaaggcttctgtgaacatctttacatgcataaactagaaagcctagagaagaggataaattcctggaaatacaaagatcttctagattaaaccaggaagttatagtaactctgaacacaccaataacaagcagcaagattaaaatgataatttaaaaattgccaacaacaacaacaaaagtccaggaccagacagatttacagctgcattctatctggcattcaaagaagaattggtaccaatcctattgacactattccattggataaaaaggaaattatctctaaatcattccaggaggccagtatccccctaataccaaaaccaaggaaggacataaaaaaagaaaactacagaccaatattcatgatgaacatatatgcaaaaatctttaacaaaatgctagctaattaaatccaacagcatatcaaaaagataatccaccatgatcaagtgagtttcataccagggatgcagggatggtttaacatctgcaagttaacaaatgtcatacaccacatagaaataattaaaaacaaaaatcacatgatcatctcaatagatacataaaaagcattcgacaaaatccagcatctctttatgattaaaaccttcagcaaaattggcagagaagaaacataccttaaggtaataaaggccatctatgacgaacccatagccaacgttatactgaacagggaaaagatgaaagcattccccctgagaactggaacaagacaatgatgctcacttttaccacttatattcaagatagtactggaagtcccagccagagcaatcagaaaagagaaaaaaatcaagggcatccaaattggtaaagaggaagtcaaactgttcctgtttgctgatgatatgtttgtatacctagaaaactctaaagactcatccaaaaagctcctagaactggtaaataaattcagcaaagtttcaggatacaaaattaatgtacacaaaacagtagctctcctatataccaatagtgaccaagctgagaataaaataagaactcaatcccttttaccatagttgcaaaaaataaaataaaatgaacaactcaggaatatacctaaccatggaggtgaaagacctctacaaagaaaactacaaaacactgctgaaagaaatcatagatgacacaaacaaatggaaatacatcccatgctcatggatgggtagaatcaatattgtgaaaatgaccatactgccaaaagcaatctacaaattcaatgcaattcccatgaaaataccactgtcattcttcacggaactagaaaaacaattctaaaattcatatgaaaccaaaaaagcccacatagcaaaagaaagactaagcaaaaagaacaaatctggaggcatctcattacccgacttcaaactagactataaggctatagtcaccaaaacagcatggtactggtataaaaatggacacatagaccaatggaactgaatacagaacccagaaatatagccaaatacttatagccaactgatcttcaacaaagcaaacaaaaacataaagtggggaaaggacaccctattcaacaaataatgtcgggataattggcaagccacatgtagaagaatgaaactggatcctcatctctcaccttatacagaaataattcaagatgaatcaaagacttaaatctaagacctgaaaccataaaaattctagaagaaaacattggaaaatctcttctagacattggtttaggcaaagacttcatgaccaagaacccaaaagcaaatgcaatacaaacaaagctaaatagatgggaattaattaaatgaaaaagcttctgtatagcaaaagaaataactgggggctggcaagatggccaaataagaacagctttggtctgcagctcccagcgagatcaacacagaaggcaggtgatttctgcatttccaactgaggtacccagctcatctcattgggactggttagacagtgggtgtagcccaaggagggtgagccaaagcagggtggggcgtcacctcactcaggaagcacaaggggtcggggaactccctcccctaaccaagggaagccttgaaggactgtgccgtgaggaatggtgcactctggcccagatactatgcttttcccacagtcttcgcaaccagcagaccaggagattccctccagtgcctactccaccagggccctgggtttcaagcacaaaactgggcggccatttgggcagacaccaagctagctgcaggagttttttttttcataccccagtggtgcctagaacaccagtgagacagaaccattcactcccctggaaagggggctgaagctagggagccaagtggtctagctcagtggatcccatcccatggagcccagcaagctaagatccactggcttgaaattctcactgccagcacagcagtctgaagtcgacctgggatgcttcagattggtaggggaaggggtgtccaccattactgaggcttgagtaagctcttttcccctcacagtgtaaacaaagccaccagaaagctggaaatgggcagagcccactgcagctcggcaaagccgctgtagccagactgcctctctagattcctccctctgggcagggcatctctgaaagaaaggcagcagccccagtcagggcttatagataaaactcccatctccctgcgacagaacaccagggggaaggggtggctgtgggtgcagcttcagcagacttagacgttcctgcctactggtgctaaagagagcagtggatctcccagcatggtgctcaagctctgctaagggacagactgcctcctcaagtgggtccctgacccccgtgcctcctgactgggagactcctccctgcaggggtcgacagacccctcatacaagagagctccagctggcatctggcaggtgcccctctgggacaaagcttccagaggaaggaacagaaggcaatctttgctgttctgcagcctctgctggtgatacccaggcaaataggtcgggagtggacctccagccaactccagcagacctgcagcagagggtcctgactgttagaagcaaaactaagatacagaaaggaatagcatcaacatcaacaaaaaggatgtccacacagaaggtcaccatccgaaggtcaccaacataaaagaccaaaagtagacaaatccacaaatatgaggaaaaaccagtgcaaaacgtctgaaaattccaaaaaccagaatgcctcttctcctccaaagtatcacaactcctcgctagcaagggaaataaactggatggagaacgagtttgacaaactgacagaagtaggcttcagaaagtgggtaataacaaactcgtccaagataaaggagcatgttctaacccaatgcaaagaagctaagaaccttgaaaaaaggttaggcaaattgctaactagaaaaaccagtatagagaagaacataagtgacctaatggagcagaaaaacacagcacaagaacttcgtgaagcatacacaagtatcaatagccaaatcaatcaagtggaagaaaggatatcagaggttgaagatcaacttaatgaaataaaccatgaagacaagattagagaaaaaagaatgaaaagaaacaaacaaagcctccaagaaatataggactatgtgaaaagaccaaacctacgtttgactggtgtacctgaaagtgacagggagaatggaaccaagttggaaaacactcttcaggatattatccaggagaacttccccaacctagcaaggcaggccaacattcaaattctggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaatagcagatctctctgcagaaagcctacaagccagaagagagtgggggccaatattcaacattcattaaaaacagaattttcaaccaagaatttcatatccagacaagcaaagcttcataagcgaaggaaaaataaaatcctttacagacaagcaaatgctgagagattttgtcaccaccaggcctgcctttcaagagctccagaaagaagcactaaacatggaaagaaaaaaccggtaccagcaactgcaaaaacataccaaattgtaaagaccatcgacactgtgaagaaactgcaacaactaatgagcaaaataactagcatcataatgacaggatcaaattcacacataacaatattaaccttgaatataaatgggctaaatgttccaattaaaacacacagaccggcaaattggataaagagtcaagacccatcagtgtgctgtattcaggagacccatctcatgtgcaaagacacacataggctcaaaataaagggatggaggaatatttaccaagcaaatggaaagaaaaaaaaagcaggggttgcaatcctagttcctgataaagcaaaatttaaaccaacaaagatcaaaaaagacaaagaagggtattacataatggtcaaggaatcaatgcaacaagaagagctaactatcctaaatatatatgcacccaatacaggagcaaccagattcataaagcaagttcttagagacctacaaagagacttagactcccacacaataatagtgggagactttaacaccccactgtcaacattagatcaacgagacagaaaattaacaaggatattcaggacttgaactcagctccggaccaagcagaccgaatagacatctacagaactctccaccccaaatcaacagaatatacattcctctcagcaccacatcacacttattctaaaattgaccacataattggaagtaaaacactcctcagcaaatgcaaaagaatggaaatcatgacaaacagtctctcagaccacagtgcaatcaaattagaactcaggattaagaaactcactcaaaaccgcacaactacatggaaactgaacaactgctcctgaatgactactgggtaaacaacgacattaaggcagaaataaagttctttgaaactaatgagaacaaagacacaatgtaccggaatctctgggacataactaaagcagtgtttagagggaaatttatagcactaaaatcccacatcagaaagcgggaaagatttaaaatcaacagcctaacatcacaattaaaagaactagagaagcaagagcaaacaaattcaaaagctagcagaagacaagaagcaactaagatcagagcacaagtgaaggagatagagacacgaaaaatccttcaaaaaaatcaataaatccaggagctggttctttgaaaagatgaacaaaatagattgactgctagccagactaataaagaagaaaactgagaggaatcaaatagacacaataaaaaatgataaaggggatatcaccactcatcccacagaaatacaaactaccatcagataatactgcaaacacctctacacaaataaactagaaaaactaaaagaaatgcataaattcctggacacaggaagaagtcaatccctgaatagaacaataacaagttctgaaattgaggcagcaattaacagtttaccaaccaaaaaagcacaggatcagacggattcacagccaaattctaccagaggtacaaagaggagctggtaccattccttctgaaactattccaaacaatagaaaaagagggactcctccctaactcattttatgatgccaatttcatcctgacaccagaacctgtcagagacacacacacaaaaagaaaatttcacgccaatatccctgataaacattgttgtgaaaatcctcaataaaatactggcaaactgaatccagcagcacatcaaaaagcttattcaccatgatcaagttggcttcatccctgggatacaaggctggttcaacatatgcaaatcaataaacattatacagcatgtaaagagaaccaatgacaaaaaccacattattgtctcaatagatgcataaaaagccttcgataaaattcaatataccttcatgctaaaaactctcaatcaactagttattgatggaatgtatctgaaaataataagagctatccatgaaaaacccatagccaatatcatactgaatgggcaaaagctggaaatattccctttgaaaactggcacaagacaaggatgccctctctcaccactcctattcaacatagcattggaagttctggccagggcaatcaggcaagagaaagaaataaagcatatacaaataggaagagaggaagtcaaattgtatctgtttgcagatgacatgattgcatatttagaaaaccccattgtctcagcccaaaaactccttaagctgataagcaacttcagcaaagtctcaggacacaaaatcaatgtgcaaaaatcacaagcattcctatacaaccaaaatagagagccaaatcatgagtgaactcccattcacaattgctacaaagagaataaaatacctagaaatacaacttacaagggatgtgaaggacctctttgaggagaactacaaaccactgctcaaggaaataagagaggacacaacaaatggaaaaacattccatgctcatggataggaataatcaatatcatgaaaatggccatgctgcccaaagtaatttatagattcaatgctattcccatcaagctacaattgcctttcttcacagaattggaatatgtaacaaacctgcacgttgtgcacatgtaccctaaaacttaaagtataataataatttttaaaaacctactttaaatttcatatggaaccaataaagagcctgtatagccaaaacaatccaaagcaaaaacaaaaaacaaaaacaaacaaacaaacaaaaaaccaaagctggagacatcatgctacctgacttcaaactatactacaaggctacagtaaccaaaacagcatggtactagtaccaaaacacatatatagaccaatggaacataacagagacctcagatataacaccacacatctacaaccatctgatctttgacaaacctgacaaaaacaagaaatggggaaagattccctatttaataaatggtgctgggaaaactggctagccatatgcagaaaacggaatctggaccccttccttacaccttatacaaaaattaactcaagatggattaaaaacttaaacataagacctaaaaccataaaaaccctagaaaaaaacctaggcaataccattcaggacataggcatgggcaaagacttcatgactaaaacaacaaaagcaatggcaacaaaagccaaaattgacaaatgggatctaattaaactaaagagcttctgcatggcaaaagaaactgtcatcagagtgatcaggcaacctacagaatggagaaaatttttgcaatctatccatctgacaaggggctaatatccagaatctacaaggaacttaaataaatttacaagaaaaaaccaaacaaccccatcaaaaagtgggtgaaggatatgagcgtctcaaaagaagacatttatgtggccaacaatcatatgaataaaagctaatcatcactgatcattagagaaatgcaaatcaaaaccgcaatgagataccatctcacatcagttaaaatggcaatcattaaaaagtcaggaaacaacagatgctggagaggatgtggagaaataggaacacttttacactgttagtaggaatgtcaattagttcaatcattgtggaagacagtgtgaaaattcctcaaggatctagaatcagaaataccatttgacccagcaatcccattactgggtatatacccaaaggattataaatcattctaccataaaggcacatgcacacatatgtttactgcagcactatttacaagagcaaagacttggaatcaacccaaagggccatcaatgatagagtggacaaagaaaatgtggcacagatacaccatggaatattatgcagccataaaagagaatgagttcatgtcctttgcagagacatggataaagatggaacccatcattctcagcaaactaacacaggaacagaaaagcaaacaccacatgttctcactcataagtgggagctgaacaatgagaacacatggaacactggagccagttgcggagtggggggaaatgagagggagagcattacctaatgcatgtggagcccaaaacctagatgacgggttgatgggtgcagcaaaccaccatggcacatgtatacctatgtaacaaacctgcacgttctgcacatgcatccaagaactgaaagtataataaaaaagaaaatgtgatatatatatatatatatatatatatatatatatatatatatgcacacatacacacaccatggaatactactcagccataaaaaggcactaaataatggcatttgcagcaacctggaaggaattggagactattattctaagtgaagtaactcaggaatggaaagccaaacatggtatgttctcacttataattgggagctaagctatgaggacgcaaaggcataagaatgatacaatggactttgaagactcagagaaaggggtgggggagtgaagataaaagactacacattgggtacagtgtacactgcttgggtgacggatgcaccaatatctctgaaatcactactatatatcttattcatgtaaccaaacttcacctgttccccaaaaacccattgaaaaataaataattctttttaaaaagaaacaaaatcattgtgttgtatacattgaatatatacaatctttatttgccaactaaatactctaaaataaaaaaggaaaaaagaaaattagcaaaggacatggacagacattgcactgaagaggacatgcagatgacaaataagcagacaaaatgttcaattttattagccttttgggaaatgcaaatttaaacaataaaatgtcactacacagctttcaaaatagttaagataataatagtgacaacacaaaatgctggtaagaatgcacagaaatattgctggttttaatgtaaaatagtatgaccacactggaaagcactttggcaatttcttccaaatctaaacatgcagctgctacgcgaccaaacaactagaccctttggcatttatctcagagaaatgaaaacttatgtccataaagaaacctgtaaaagaggatttatacagccttgtttgtaataacccaaaactagtgacaaccaaaatgtccttcaacagctgaataattaaacaaactgtggcatatcagtatcatggagtagtactcagcaataaaaaggatcaaactgttgatacacacaacaacttggatgaagttccagggaattgtgctgagtggggaaaaaaaagacaatcccaaaaggtgatatactgttttattccatttacgtaacattcttgacatgataaaattatcaaagcagaaaagagattaatggttgagggactggatgagacacaagtggatgtggctttaaaagggcaacacggatctgtgtagtgatgaaaatcttctgtatctgactgcatcaatgtcaataatgtcctggttttcttatcatactatagttttacaagatgttatcattaagggaaacttggtaaagggcacacagcatctctctgtattatttcttaaaactgcatgtgaatcttcaactatctcaacataacaacgccttaattttaaaaaattttagtcataagaaaccaagacacacatacatacagataatatatttaatgttatagaaataaattcataatatattgtgaaataaaaatagtttgcaaaacaatgtattaaaagtaatggcaaaaagcgcaattaattttgtaccaacttaatatatgaaataacctctttttgatgaatgtatttatctatatatgtgaggaaataaagcataagaggctatacacataaatgttaaagtgggtggtatcatggatgatttttattgattttattttcacttagtgatattttgtaatttatgtaactaaaataaaataaagtcacttttttaaaaaagaatgagatcatgtcctttataggaacatgaacagagctagaagccattatccctagcaaattaatgcagcaacagaaaaccaaataccacacattctcacttacaagtggcagctaaaagatgagaatacatggactcagaaaaaaaaatagctaatgggtactaggcttaatacctgggtgatgaaataatttgtacaacaaacacccatgacacaagtttacctatataacaaatctgcacatgtacccctgtacttaaaagtgaaaacaaaaacaaaacaaaagatcatttatcatgaccaagtgcaatttattccagtgatgcaagaatgattcaacatacacacatcaattaatgagatacatcatatcaacagaatgaagaacaaaaacctcatgatcattttaattgttgctgaaaaagcatttgataatattaaacatccctttatgacaaaaaaccctcaaaaacatgggtatagagggaacatacctcaacagaataaaagccatatatgacaaacccatagctagtattatactgaatggacaaaaactgaaatcctgtcctctaagattgggaacataacaaggatgcccactttcaccacagttattcaacatagtactggaagtcctagccagagcaatcagacaagataaagaaataaaaaggcttccaaattggaaaggaggaagtcaaattaccttgtttgcagatgatatgatcttatatttggaaaaacctaaacactccaatgaaaactcttaaagttgataaattcagtaaagttgcaggttacaaaatcaacgtacaaaaatcagtgacatttctatatgccaacagtgaacaatgtgaaaaaaaatcaagaaagtaattccatttgcaatagctacaaatgaaataaagtacatagtaattaacaaaaatactaaaagatttctacctgaaaactataaaacattgatacaagaaattgaaaaagacatacaaaaatggaaagatattctatatttatgaattggaagaataaatatagttaaaatgtccatagtacccaaagcaatctatagatttaatgcaatccctatcaaaatgacaaagacatatattcacagaaatttttaaaaatcctaatatttatatggaaccaggaaagacccagaatagccaaagctatctcctaagcaatacctgacttcaaattatactacagagctatagtaaccaaaatggcatggtcctggcataaaaaaagacacatagatcagtggaaaagaatagagaacctggagataagtctatacatttacaatgaactcattttcaggaaaggtgccaagatcatacactggggaaaggtgctgggaaaactggatatccatatgcaaaagaatgaaactagacccctatctctcaccatatacaaaaaatcaaatacaaatggattaaaggcttaaatctaagacctgaaactatgaaactactaaaagaaaacattagggaaactctccaagacattggagtgggcagagatttcttgaataatatgccataaatacaggcaagcaaagcaaaaatggacgaatgggatcacatcaagttaacaagcttctgcacagcaaaggaatcaacaatgtgcaaagacgacccacagaatgggagaaagtatttgcaaaccacctatctgacaagggattaataaccagaatatataaggagctcaaataactctataggaaaaaatctaatactgtgtttgacaaatgggcaaaagatgtgaatagacattcctcaaaagaagatatacaaatggtgaagagccatatgaaaaggtgctcaatgtcattgatcatcagagaaattcaaatcaaaactacaatgagatatcatctcagctcagttattaggttggtgcaaaagtaaatgcggttttgccattactttcaattgcaaaaaccgcaattacttttgcaccaacctaataaaatggcttttatccaaaagacaggaaataacaaacgctggcgaggatatagagaaaagggaatcctcaaacactgttgatgggaatgtaaatattagtacaaccactatggagaacagtttggaggttcctcaaaaaaatgaaaatagagctaccttatggtccagcaatcccactgctaggtatctaccccaaagaaaggaaatcagcatatcacagagatctctgcactcccacattcattgcagtactattcacaatagccaagatttggaagcaacctaaatatcccatcaacagatgaatggatacagaaaatgtgggcatatacacagcagagtactattcaaccataaaaaagaatgagattcagtcatttgcaacaacatggatggaactggacgtcatatattacataaaataagccaggcacagaaagacaaacttcacgtgttctcacttatttgtgagagctaagaacaaaaacatttgaactcatagagagagtaaaggatggctactagaggctgggaagggtagtgagtctgtgtgtgtggggaggtgaagagtgttaatgggtacaaaaaatagctaggaaggatgaataacacctagtatttgctagcacaataaggtgactgcagtgaaaaataatttaattgtacatttaaaaataactaaaacagtataattgaattgtttgtaacccaaaagataaatgcttgaggggatgaatatcccatttacctgatgtgattattacatgttgcatgcctgtatcaaaatattccatgcaacccataaatatatatacctactatgtactcacaaaaattaaaaattaaagttaaagaacaattaaaatggggaagagatttgaaaactttacaaaggaagatatacagatgataaataaggacatgaaaagatgcccaatatcattagacatgtgggaaaggcaaattaaaaccacaatgagataccatgataaacacattagaataactgaaatgaaaaagaatgaccataccaagtgttgacaggaaagtggagcaagtggaactctcacataatgaagtgaagtgtaaaatggtacaactgctttttaaagtattttgtcaaagttaaacatgtacctatgaaaatagagaagttcaaaaagaagaacaaaaaacacccccaaataaatgatattatgcagaggttgcagacattgcaatgacaaaggtaagcgtatgactatgggaagaagcacctgagagatgatgaggactaagatccctggaggagggaaagtcagggatctgaggggctagagtgttggaagaatcatctgtgtagatattaaaatcaccaagaattatgataggaaagactagagagagtagcctatagaaggaaataaaaggtacttcatcttacggctgctctgatctattatgcgtagaattattaaggtccagaaacactggacaaaatttcaattttttgacaaaattttctttccctgatagtggatgtgacaaagaaaatgatattgttgatctttatgatggcagggtgtgaagaggaatgggaagaggcaaccaaccttaccagctgcatttgttttgtaatagaagtcagactaaggatccaatcaaaactaggtttagtgagtggaaacatgattaagggtgggaggcaggaagaagaatggagtctgataatagatacagcaggaagggtggatcgcctttggcaaaaggaaaatcaaaacactgaggtgtgggggaaatgcagtaaagttttacaggaaaactgaagggtttttttttctgttatgttatgctgatttaaagtgccatcacatacaattttaggatataaattcgctagcctgattgatgaattactgatctcttaattatcttcagctggcaaagacaggatgcagccattcaccaaaacaatttttttctttgtgtttgtgatctaagtttttaaacatgaaaaataataatggcaacaatagttaacatttataaagtgtttactacattgccaactactgtgctttatacacttgttttatttaatccttacaaataggatgatgctatgaggtaggctctgttattacacttgttttacaggtgaggaaactgaggctcagagaggctgacttgctcaagtacagtcggctaatcaagagttgatgacatacatcctcttctcactcagtaaattcaggaccaggactatatcctccagacaccatactcttaaacactgccttctctcatttaatagttttgttgaatttttatattaatcagtctttataagtatttataatagctataagatactttgaaatggtctgaacactcagagtagagtatcatctcttccttctttcccccacacattaaaaaaagtttttgacaaaagtattacattcagaattttggcccaaatgttaaattccataattttatgtacaaatatactaaaacttaattttagagtctttggtacagaatgcaaacattccatttaacaacaaacaacaaatcattaagattatttcatccctacacttagagaaaataaaatgtgtgttatgaaatctttgttcttagttattggatagaaaccttgctcaaatcattcagagctaaaagacaatgtttttattgactacacagaacacatagatatcgtagtataaattcttaattgtgacaggagaatgcttaatctcttgtagtaatgccttttaaaaattactcattagcacttttagtctttctcaacccctatttcccctcccagtatcttccacgaaacttctagagatctgtggaacacagcttaaaataaaacaaaaacctggaccagatgatatttgaggttcttccagaaaatctgtaatttgtatcaatgtcattagataagcttacatctaaagcactccacctgataaaattctggactagtttactaaaaagttcacacaactgaaaacaattgaataatattagacatagctattttaaaggaatagaattctaactctgccactaactagctatgtgaccttggacaaagttacttagctgctctttgctttaatttctgtattcataaaagagggttaataaaccacttagcacagtgcctaccatatagtaagtactcaataaattattggttcctttgaaagttattatttaattcaacattttctcatccatgtgtgacttgctaaagtttcctgtccagattaccacccaaatatgaaaagtctatgaagataaacacataggtgaaagccaacaattgatttcaggagtctaattgagttgaatgaacagttcagacaaagggaacactttagttacccagtgaagagacattacttctgatttggaattggtaaatgtaaaaagccagttaggaaattacagctcatttatatcctatctgagcagttatatgttttgctacaacccagagatagaagaagtcgctcttatgcccgatagtttagcaaacacttaattgcattacctagcactgcaggaattcaagggtctttctcttacaattttgaaaagacaggttgatgatgtccttggtgtatatatgtgacaagctgttaaataatctaactggctgtaaaagcattacttttgccaataggtatttaacttaacatttggtaagtatatcttattttatgtctttgtaagccatcagggagctgtatagttttagaggcaagttacttaaactttaatgccttagtttacctatctagaaatgatgagaacaacattataatattgtaataactaaaagttgtaatgaagtagtaataactactactatcactactactactgatgatgctagtactatacaagcaccattaataacaacctatctcctaagttgttaggactaaattaggtaacatatgtaaagtatttagaaaagagccaggcacaatatgagtttgttattgttcttattatcctgaatactatccaatagtcagtgaaaataaagggaaaagctacacagttaatgtaagcgaggatttagtaagctgtttaatttctactgggaataacccatataaatttttctttcttgatgagctaatttggaaacacatgttcctttctcttgatttaggggttttccaaagtgcttttctgaaaagttgacatgttaaaaaaaaaaaaaaacaactccatggcagaccaaaaagaagaagcagagcattctaaaatgtccccctcctcacataacaagcacacagactcctgttttttttctcccagtgtccatgtgaccctgctgtgatgtttgtccattgtagaagtttagaaagttctgtctaggctatgtgtgggaatggagttctcaggtcattctcggccctctcctccacccagtcaggccttccaaaacctatctcataaaacacagattttgagacttggaaagcccttaaggatcatcttgtcatgctccttcattgtatagatggagaaaaaaaagtctggagagaaggagggatttttctaaggttatataggaagccattaagaatataatttagtcgctcactacaaaccagtctagtgcttttccaccatatcaccttgcctttttcagaagagatctgttttcctgttgtcatctaagaacagtcacacacccgggcattcttctagaactcagagtaggaaaataatcacaacattctttcctatctctagcccaaatgtggagaatttttaaagacattggacttcagtgtcaaaaactaatatattctacatgcagttattataactggaaaacttacctttacaaaaagctcaatctcagggtccacttgagtgccgggccgcaggcctgacatctttgtctttactgccagttgtcagcctcctgcctcctgtagagtccacaatacttgtagactcttttctcaattttatccaaagactcaagtaatgttggtgctttaagaagaccgtctagcttgtagtggactgagtcagacctggagccagtctcttctctcaagaggtgtgacgcagaaaattctagatgcttaagtgcagctcttgaaatcgttttccttcttcctcgtgatctaacatttaaatcaaggaggagccaaaggggtgtgtataaactgcctggctagaagggtgggggtgtttccagagaggcttcaatgccatgagtcagcacaggagaaacacatgcacagaaacacacacatgcagtgctagtttctatatatcaagcagaccagatgttttctagagcctccctttgagacctgggctccatgcccagaaaagggcctcttattggtgttcctgtaacttgaaagcacttccaggaaaagggccagaaatgacttggatttttattattgaaaaggatgtttatccagtgatactgtctaaaagagggttaaaaaattgtacttcattaaatgtttccacccccaatcctactgctcacacagccagatttctgttctgggttgcaaatttcacttctctctacaaccagggaatgttcactggggtggttgagtctgggggcttgtttagtgtgccccacctagttctttatttcttggaagcttggactggaacagatcacttccttgttttggcgtctgtatcaggaaccatgattagttctgtatttctgcttgtcaaccctgggaacagcagtaaaaccagtcaaactgaatgtctctgtgagatcactctgtgtctgcaatgtttctgacagctgtatctgatgcctccaggggctgggagggggaccccgggattaacaaacctctttggtgggaagagtctcttcctgcttggagccaaactgaacatagatccatcagttgggcaccactgtgatcccctttctataacaccaagcattccccatgctcatatgggctgtacatgcacctgccattgccctgtgtaaagatttacaggataagaggctcttgaaaaaacccagcctgctccatacctgtaggttctagggaaggagtggctgatatgtaggtgagtgttcttctggatgagggaaagacctcatgattccccaaatggtttgaaaagtgagaagaaaattgtgctggacatctgctgagccaaccttaatggtgagttttgtactggctatttggcaggacctggtgtctgccttgtttagctatattttcactctattaatcatactctgttcattcactccaaaggcaatcaatgaatgtcaactctgtgccaggatgctgatccattcactgagattggcagcacaggacagccagttcgggaggacaacaggaattcaactttaagcatactcagtctgaggcctcctcacctttccccactccctatatctaactgctacaaaatcttgtcacttctacatcctgaatattttaaaaaatccatccacttctctttgccccatgactactccaaatttcaagccagcaatattcttttttaattgatttaaaaatttttattttaaaagaccaaatggttgcatgaccctcgactctcatgggaaaaccacaacccaccaccaccacagcaacaacaacaaacagcctaatgacctctgtatgatccctaataaattgccaaagtaaggagatgaaagttctctttttttcttgatgctcacagtgtttaaatattgtatttaggataatttacatgccataaaatttgcatatttaaagtgattttataaatttattgggtggtgcaaccatcactacaatctaattttagaacatttgcatcacgtcagtgacatctttcttacccatttgtaatcaatcttcattaccactcccagtattaggcaaccattaatctactttctgtacctatggatttgcctattctaaatatttcatataaatgttgtgttaatccatttttgctttgctataaagaaatacttgaggctgaataatttataaagaaaagaggtttaattggttcatgattctgcaggctgtacagaaagcatggtgccagcatctgcttctggtgagagcctcaggaaggtagagtgggagcatgcatctcacatgatgaaagtgggaggaagagagaaagtggtggggggacatgccacactcttttaaacgaccaactcttgcaatgaattcagagggagaactcactcattactatgagagtggtaccaagccacccatgaaggacctgcccccatgatgaaaacacctcccaccaggccctaccaaaacttgtttgctctttgctttgtttgcttataatagtcattccagtggctgtgaagcggtatcttacggtgatatttttcgattttaaaaatggatttagagggtacaagtgcagatttcttacatgcatatatcgcatcgtggtggagtctgggcttttagtgtacccatcacctgaagagggaacattgtacccaagaggtaatttttcaacccttgtcaacttcccacccttttgtagtctccaatatctattatgctactctatatgtccatgtgtacccattgttaagctctcacttacaagtgagaatatgtgatatttgactttctgtttctgaattattttacttaagataacgtactccagttccactcatgttactgcaaaacacacgacttcattatttttttatggctgcatagtattccacgtatatgtaaaatgcagatgggtagatacccagtagtgagattgctggatcaaatggtatttcattttttaccatgtttagttctttgagaaatctatttttagttctttgagaaatctccatactgttttccataaatgtgataatttacattcccactaacagtgcataagcattacttttttctccacatcctcaccaacatctgttgttttttgatttttaaataatagctattctgactggtgtaagatagtattgtttggttttaatttgcatttctctgataattagtgatattgagcatctttcatatgtttgttggccacttgtatgtctttcaaaaaacacccattcatgccctttgcctactttttaatggcgttacttgttttttgtttttgtttttgtcgttgttgttgttgttgagttgttggagtttcttgtagattctggatattagcctttgttagatacataatttgcaaatattttttctcattaggtaggtttactctgttgattgtttcttttgctgtgtggaaggtttttagcttaactgagtcccgtctgtttatttttgtttgtgttgcatttgcttttgaggacctggtcaaaaattctttgcctaagccaggccaatgtccagaagaatttttcctacattttctcacaggatttttacagtttcatgtctaaagtataaatctttaatccatctcgagttaattcatgtatatggtgagagacaggggtccagtttcattcttccgcatatggctagccagttttcctagcaccgtatattgaagagggtgttctttctctattgtttaattttgtcaatattgcagaagatcagttgttaataggtactttatttctgggttcactattctgttccgttggtctatatgtctatttttataccaatatcatgacgttttggttactatagccttgtagtataattcaaagtcagaatgtaatacttcaagctttgttctttttgcttaggattggtttggctattcagactcttctttcggtttcatatgaattttaagtttttttaattatgtgaaaaattgtgttggtaatttgatagagactgcactgaatctgtaaattgctttgagcagtgtggtcatttttaataatattggttcttttgatccatgagcatgggatgtgttttcatttatttgtgtcatacacaattttttcatcagtgttttgtagttcctcttgtagagatctttcacctccttgattaaatgtattcctaggtgttttattttttgtggctattgtaaatgggttcttcatttggttcttagcttgaatgatattggtgtagagaaatgctactgtgttttgtacattgattttgtatcctgaaactttactgaagttctttatcaagtctaggagtcttctggaagagtcttttggagttttattgtacattatttggggttttcaacataatggggtatatttttctcctttataatatgtatgcctttcatttctctctctctctccctctctctctctctctctgtgtgtgtgtgtgtgcgcgtgtgcgtgtgtgtgtgcatgtgttatcgcactagctgggacttccaggactaacagtgaatagtagtggtgagaaaggacatccttgacttatttctgattttaggggaaaattactcagtggttcactgtaggttttccatggatagcctttattagaataaggaaatttccttctattcctaacttgttgggaattttatcattaattaatattgaattttgttgaatgccttttctgcatttatttatatgatcattcgatgttgcgtatttagtatgacaatatgataaaatacattgattgatttttgaatgttgaaccaactttgaatacctgggataaactccacttgatcttgatgcattatcttttttatacattgctagagttgattggctaatatcttagtaagaatatttgtacctatgtttatgtgagatattgctattttgttttttgctcgtaatatctctgtctgagtttggtattaggatgatgctatcctcataatatgagtggggtcattttctctccttaattttctgaaagagactgtaaaatttgtattacatcttacttaaatgtttgatagaattcatgagtgaaattgcctggcccggagttctctttcttgaaaagttttaaattacagattcagtttctttaatgcatgccaggctattcagattatctacttttctttgaattagtttgtttttttttaccatgtgggtttaagaaattggttcatataagttatcaaatatataggcatagattgattgtagtattccccctcttattcttttagtgagaacattcaaaatcatctcttctagctattttgaactatacaacatattatcgtcgactattgtcaccctattgtgcaatagaacaccagaacttaatcctcctatctaaccataactgtaactttgtacccagtgaccaacctcttcccatctctccttccctcctcgcctcccctgcctctggtaaccactgttctactctctacctctataacatcaacttttaaatttatatttatcttatttttatttattatttttgtggttacatagtaggtgtatatatttatgggttagatgagatgttctaatataggtatgcagtacataatcacatcagggtaaaaatggagtatccatctcctcaagcatttatctttgtattacaaacaaccaaattatactcttttggttattttactttattttatgttttatgattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatgtgttttcattgttcaattcccacctatgagtgagaacatgcggtgtttggttttttgtccttgcgatagtttgctgagaatgatggtttccagtttcagccatgtccctacaaaggacatgaactcatccttttttatggccgcatagtattccatggtgtatatgtgccacattttcttaatccagtctatcgttgttggacatttaggttggttccaagtctttgctattgtgaatagtgcagctataaacatacgtgtgcatgtgtccttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagacggtatctcattgtggttttgatttgcatttctctgatggccagtgatgatgagcattttttcatgtgttttttggctgcataaatgtcttcttttgggaagtgtctgttcatatctttcgcccactttttgatggggttgttcgtttttttcttgtaaatttgtttgagttcattgtagattctggatattagccctttgtcagacaagtaggttgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgctcatgcctatgtcctgaatggtattgcctaggttttcttccaggatttttatggttttaggtctaatatttaagtctttaatccatcttgaattaatttttgtataagctgtaaggaagggatccagtttcagctttctacatatggctagccagttttcccagcaccatttattaaatagggaatcctttccccattgcttgtttttgtcaggtttgtcaaagatcagatagttgtagatatgcggcattgtttctgagggctctgttctgttccattggtctatatctctgttttggtaccagtaccatgctgttttggttactgtagccttgtagtatagtttgaagtcaggtagcgtgatgcctccaggtttgttcttttggcttaggattgacttggcgatgtgggctcttttttggttccatatgaactttaaagtagttttttccaattctgtgaagaaagtcattggtagcttgatggggatggcattgagtctataaattaccttgggcagtatggccattttcacgatattgattcttcctacccatgagcatggaatgttcttccatttgtttgtgtcctcttttatttcattgagcagtggtttgtagttctccttgaagaggtccttcatatcccttgtaagttggattcctaggtattttatcctctttgaagcaaatgtgaatgggagttcactcatgatttggctcttttggttattttaaaagtatgattaaattatttttttactacagtctccctgttgtgctagcaaatactaggctttattcattctttctaactattttttgtacccactaaccttccccacttcctcctcaccctcccactaaccttcccagcctcccttctactctctatcttcatttcaattatttaatttttagctcacacaaataagtgagcacatgcaaagtttgtctttctgtgcctggcttatttcacctaatgtaatgtcctacaggcttatccatgttgtcacacatgacaggatctcattattggttatggctgaatagtactccattgtgaatatgcaccacattttctttatccattcatctgttgatggacacttatgttgattccatatcttggctattgtgaatagtgctgcaataaacatgggtgtgttagtcaaggttctccagagagacagaaccaataggatatatgagagaggatttatgaggtgtagttggttcagatgattatagagatggagaagtcccacaataggccatctgcaagctgcagaaccgaagaagctggtagcacgattcactccaagtctggaagcctcagaactagggaagctgagagtacagaccccagtctgaggccaaaggcctaagagcccactggaggctgtggatgcaagtcccagagtccaaaagtggaagaaactggagtctgatgtccaaggacaggaggaggaaagaaatctggctgcagaagggagataggatgagcagagagagagaattcctcctcttctgtctatttgtcccaaccaggctcccagctaacaggacagtgcacgcccgcattgaaagtggatcttacctgttgcagtccactgtctcacacaccaagctcccctggaaacactctcaccgacacacccagggaacaatgtttcaacagccgtcttggcatccctcaatccagtcaagctgactcgtaaattgaaccatcacaatgagagtgcaggtatctctccaacatactgatttcatttccttttaaaatacccagtagtgagttctttggatcatatgctagttctatttttaattttttgaggaacctcagtactgttgtccatattgcctgtactagtttacattcccatcaacaatgtataagatttcccctttctacacatcttcaccagcatttgttgtttctttaacataaagagtgtaaaatcactttattagaaagtttaactaatcagtcacaaatgaacagcatttttgagcactaaacagaggattaaaataatttccaaacactagagaaaattattgaaaattctaatattttaggcttaaaatatcattaccctcatgaaagcaaaaatcctatagatgatattttctaatatatatatatattctaagtactatgaaattataatagaaatcatcaattaaagtgtaacaagtaatatctaaccacgggcaaatttcttttaagatcactttattatattttatgttattaaattaaattttgatttttttaattattatgggtaaataatagttgtatatatttatggagtgcatgtgatgttttgatacaggcatacaatatgtaatgatcaaatcaggataattgaggtatctatcatttcaagcctttattatttctttgtgttaggaacactccagttctactctcttagttatttttaaatatacaataagttattgttaactatagttgccttattgtgctgccaaatactagatcttattcattctctctgtgtttgtacatactaaccatccttactttcagcctattttttgtctttttaatgatagccattgtaactggggtgaggtgatattgtggttttgatttgcatttccctaatgattagtgatgtggagcatttaaaaatatacccatttgccatttgtctgccttctttggagaaatatctattcagaacttttgtccatttttaagggaatatgtcttttttggttattgagtttgagttccttatatactccgggtattaatctcttgtagatgcatagtttgcaaacattttctcacattctgtgagttatctcttcactccgttgattgactgtttcttagaaattttcaaattacgatacattgttattaactatagtcatcacatggaaaaatagatcacttgaacttatttctctgatctaaaattatgtatcctctgagcaacatatccccaaccacccaaccactactccacaacccaccagcctctagtacccaccattctgctctctatttctatgatatcaactttttttttacattacacatatgagtgagatcatgcagtattgatatttctgtgcctggcttattttcacttaatgttctccaggttcatccatgttgtcacaaatgacaggactttcttctttttcaaggatgaatagtattccactttttatgcataccacattttctctatatacactcccatgtattctgcctagattgattttatatcttggctattgtgaatatttctgcaaagaacatggaagatatctctcggacatactgatttcatttcctttgggtatatacccagtggtgagattgctggatgatgtagtagttctacttttagctttttttagaaacctccgtattgttttccataatggctgcactaattcacattcccaccaacagtgtgcaagggttcacttatctccacatcctcatcaacattgttatcttttgtctttttaataatagccatcctaaggagtatgagatgatatcccgtggtggttttaatttgaatttatctgattactagtgatgttgagcactttttcatatacctcttggccatttgtatgtcttcttttgagaaatgtctatccagatcctttgcccatttttaaatcaggttatttgttttcttactattgagttgtttgagttcctcaaatattttagatattaaccccttatcagatgtatagtttgcaaatactttctcccattctgcaggttgtctcttcattcttttgtttcctttgctgtgcagaagcttttcagtttgatgcaatttcatttacctagtttttcttccgttgcttatacttttggatcatatccaaaaggtaattgtatagaccaatatcatagagttataccatgtgttttcttctagtagatttacggtgtcaggtcttacatgtaagcgtttaatccatttctagttgatttttgtatatgttgtaagaaaagggtctaatttcattcttctgcatgtggacatccagtttccccagcaccgtttattgaatgtataagagttcttttctctccacatacttgccaacgtctgtcatttttggtctttgtaataacagccattctacaatggccatattcccatactgtgggttgtttcttcactctgttgattgtttcccttgcctcacagaaactctttagtttaatccagtctcatttgtctatttctgggttttgtttcctgtgcttttggggaataaaatcttttcccagagcattatcctggagagtcatcccgaggttttcttctagcatttttataatttctatagctcctccaaggtcacacacctgaactgagattgtaatggtgatctaactgaaagcctatttatctacctatctgaaagcccaccagctttcacttacaccacaatacacaaatccatcaaatgcatcgtctgctcaattatggagctctcttgggaaatacttgtctgtcaactaagaagaaggataactttgttaaatcttcctagcttttcttgtcagataaatgcctgctttatttgctctcccctactcccacgtctctcttgcttcatatcaaagcaggaaaaaaaggaaaaactgcacaataatatgatggcatcactttgtgccaaagtccagaaatagtcttattctaatccaaagtattgcacaaccattttgcttatgtgtaatagacttttcctgctactttctctgttggctttagaaaacaccaccatctaatataaatagtgaataccaaattccatgtaagcttggacaaatcacaaggtcttatcattattttccttatctataaagtaagacaataacagctgtactacttacctcacgtggttatcatgcagagggtcaatcagatagtgtatatggaaacatttctaaactgcaaatctcagtttgaagtcaaaagattgtaagtgtgatctgtaaaaatgttgctctcatgaacaagcgtacacaggaattacgatcatttttctgttctctggtataaacaatgagttaaagaattaaggacacctgatttcaaaacctctctgctacgtatgaactctgtggcaggtctctaagtttcagttgccttaaatgtaagaggaggttaataacacctttccttctgggatgatgaaataagtaaattaaataatattttcacaaatgcctaacccagcactagaagtttctggaaatgacaatgggtgtcaacagcctggtgaagactgtgcttcctcactccattctccctccaggcatggctccttgaagcctgggaggatggactattatattctttttctttctttctttctttctttctttctttctttttttttctttgagacagagtctcgctctgtcgcccaggctggagtgcagtggcgcgatcttggctcactgcagcgtccgccacccaggttcaagtgattctcctgcctcagtctcccaagtagctgggactacaggcgcgtgccaccgcgcctggctaatttttttgttgttttgttttgtttgtatttttagtagagatggggtttcgccatgttggccaggctggtcttgaactcctggcctcaggtgatctgaccgctttggcctcccaaagtgctgggattacaggcgtgagccatcgcgcccggcctatttttgcatttgattcttgcagtagccctgtgagatcagctaagcagatgttattatgctcattttatatgcaacaaaactaagaatgttggctctgattgtgccatgtactatctaacactaaggaatattgcctgagatatccaaaaatggcaccattggatgttaatttatctttggaaagaatatctttggcagtatctagtaaatctgagcatacacataccttatgatccataagttccattcttaagtttatttcaaacaggagtgaatatatttgttcaccaaaagacatgtaatagaatgttcataacagcactgtttgtagtagttccaaaccggaaattactcatatgtccatcaacagtagaatggataaactgtggtgtgatcacgcactcaacttccatatagcaccaataaactattgctaagcaatgatgaaactcctaaacataatattaaatgaaagaagccagacacaaaatgaatacatattgtgattgcaattatataaagttttatataaacaggcaaaactaatctttggtgatagaagtcaggatggtagttacccgtgggttgggggatgggcgttactggaaaggggcataagggagggttctggggttctggtaatgatctgtttattgacctgggtgctagtgatatggatgcgattacatcatgaaaattcatcaagcttacgatttgtgtactttttccgtaatgtatagtatacttcagtaaaaagttaatttgccttaggcaaaacagaaacccattatcttaggcaaggtttttcagtggcttcccatggtactcagaataaaatccaaagtccttaccatggcctgcatggcaatatatacatgatctagcccctgactacctcctccacgtaatttctcccaccattattccccttgcttactcagctccagccacgtgaccttcttactggtcggcaaacagaataaaactccattccactccaaggctgtgtttttgcttttccctttgcctggaatgctctcccctcagcttgttacattgttggtctcgtatcatacaggtaacagctcaaatgtcgcttcttcaaaaagtccttcacttaacactccatgtgaaatagatttcccagtcgctctttattatataacactattattttttcatagcatttatagctagctgaaattactttgtttatgtatttattacttgtttatcatctatcttcctcaatagaaggtaaactctgtccaaagactgaggtcgtgtctgctgtattcgtccttgtatctttaatgcctgacgcactgcctagcatgtagctggtgcgcatataaatgttagggttgaacgaatgattgaagatccctgggtgaatggtccactaggctatagctgggattcctcccacaaagggagacacttaagttgtaagtcatcctgttaaaaggaaagctttgttagtacaacctctcttgtccaccccacctcagcttggtgaggagaaagctcagcgctttccccagtgcttccatgacctttggccagtaaagacttaaaatatcatatcataagatgagagaaaccagttggaacttaacttctatcccgtatccttagattattcaaagaaaaacaaaacacggtcaacaggcagtggaactcctcactccaatgtgatattcctgagagaatattgacttatcgtcacttcgtctctgggacaagtattgaacataggggaagccttatataaaattgttcaataaacaaaagatgtctttaacatgtgtttgagatctttcttctcatgattccatgttaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtgggtcctaatctctaaagatgtcaagcaagcttgtaatactgaagcagtgaagaacgggtacttacttaatatgtgagtcacgatgttgcaaaggaaaaagagaaaagagtccttggttttgtttatggtcctgccgcccactcactgaatgctctggaagcaagcctcatcccatctctaaggcatcagtgactctatttgtatgatgaaggggtttaactagatgacccccaagggtccttccagcttcatgattccatagtttttatttttggtatttcctctggatgaaaaataccttcagcttagcataaaatgtcatgagataatttaaccctttgagaaagggtagaataagaattaaagaaaaagaaaaagaaacaaaccaattatctgatttactttgataagagaacaattacttgagaaacagaagctcctccagtgcagggcccattacctactgttgcctctgtaacttccatttagcctactacagggctatacacatcttagtttccaaaagtttgtttaatttcaaaagaaaaatatctcatttaatgcaaccagaaaacaacctaaaggttatcttttaaatgatctcttctgacttagggttcctttggtctgtccttcttctgacagtgttttctctctgtttttttttttttttggcccattcacaggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcaccagaagttaccacattctctgtatgtatgtcctttttcgtttggcatttagctgacactgacttttgtttgctttcatctagagtgaccaaccatcctcttgtgcccagaactacaggactttccattttaaaactaggagagtcccacacaaaccaggactgttggtcagtcaccgtaccttcttgctgctagatatgtaattttctttggttttcatcaccggttcccatttctttgaaagtgtttgtaggtcacacactgtgtagtccatgatgaaaagaacaaaagatgtatgaattatggtgtgttgtggtggttcccaaagtagggtccccagaccaccagcagtggcatcatttgagaactccttagaaatgcaaattttcaaggcccaccccacgcctactaagtaagaaactctaggcatgggtaccagcagtttgttttagcaagtcctctgcaggattgtaacacatgacaaagtttgagaactactgacaggaagagtcctgctgctgagttctaggcccagttctgtcactggctcactaaatgacttcaggcatgtccctctcctattttgaacttcagttttctcttctgtgaaatgaaagccttggactaggcagcgtctaaaggctctgtcactccgtaattgtgtgactttggtaactttgtttgacttctccttgcttaagttttctcatatgggtatggtaaggaaaatacctacctcacaggattttctaacaattttgtgattattaagtatgatgactgatgactaatatatgacagccagctcttacacagtgctttctatatcctggactgttgtaagtgcttttaatccccgcaacaatcccatctccattttacaaatgaaaaatagaggtcacacggctaatacgtgtcagagtttggattaaaacccagaaaaatctgtccccagagacaatgattttaactagcatgcccttttgctcaataaatgttaattccctcaccctttccacacacacacagtctagctgaccattcatagacaataatcccactttcacagtccatccaacaagatcttaaaagaaccatgagaatctctaggtttcttttgcaaatagttttcaagcatttaaaaaaaaaaggtggggggcggggagggagtggccaagatggctgactagaagcagctaggatgagtggttctcatggaggggaaggaaaggggcgagtaaatacagcgccttcaactgaaacatccaggtacccacattgggtctaatcaaggaaacaactcgatccacagagaatgaagaaaagcaaggcaggatgacagcccacccaggagcaacatggagacagaggaacctcctccacccagggaagtcgtaagtgaatgtgcgatcctgggaaaccacgctcctcccatggatccttgcaacccttgggtcaggagatcccctggtgaacccactccaccagggccttcagtctgacacacagagatacatggagtctcagcagagtagccgcttgagcacgtgcagagacccagcagctttacatactccggccctgggtttcccagcaaaagtaactgcaactcctgcaaagcgggagattagacccctgtacatacccctaggaaagaggctgaatccagggggccaagcggcacgatctgcgggccccacttccactgcacctcacaggataagacccactggtttggaattccagccagccaccagcagcagtgttgcacctacctgggacggaggtcccagggggaagggcaggctgctctctgggacagagctcccagaagtggtaccccagaacagcacagcacagctgctcttcagaagcatggccagactgcttctttaagcaggtgcccaatctgttcctcctcactgggtgggacttttcaaccaaggcctccagcaacccctactggtgttctctggctgacagagatttgaattctccctgggacagagttcccggagggagggaggggccaccatctttgctgtttgggcgacttagctgttccggcctccaggctttggagagcccacaccaaccaggggtggaagcagtgccccagcacagcacagctgatctgtgaaagcatggacagactgcttctttaagcagttccctgatcccgttcctcctgactgggtgagacctcccaaccagggtctccagccttgtcctgcaggcgcatttgggctggcaacaggtctgtacctcgctgggccggagctcccagaggaagaggcaggatgacatctttgctgtttcacagccttcactggtgatagctccaggtactggaaaatccaaggagactaggaactggagaagaagcccagcaaagtacagcagccctacagaaacatggccagactgttaaaagaaaaaaaaaatccaaaggtcagcaacctcaaagactgaaggtagataagcccacaaagatgagaaagaatcagtgcaagaatgctgaaaactcaagaagccagagtgccctctttcctccaaatgactgcatcacctctctagcaagggttcggaattgggctgaggctgagatggctgaaatgacataagtagaattcagaatatggataggaatgaacttcactgagttaaaagagtacattgtaacccaatgcaagcaagctaaaaatcatgataaaacattgcaggagctgacagacaaaatagcccatatagagaagaatgtaaccaacctgacggaactgaaaaaacacactacaagaatttcataatgcaatcacaagtactaatagcagaatagacaaagcggaggaaagaatttcagagcttgaagactggctttctgaaataagactggcagacaagaatagagaaaaaagaatgaaaagcaatgaacaaaacctccgagaaatatgggatcatgtaaagagagcgaatctaagactgattggtgtccctgaaagagatggggaaaacggaaccaatttggaaaacgcatttcaggatatcatctatgagaaattccctaacctagctagagaggccaacattcaaattcaggaaatccagagaactccaggaagatactccacgaaaggaacatccccaacacacataatcatcagattctccaaggttgaaacgaaagaaaaaatgttaaaggcagctagagagaaaggccaggtcacctacaaagggaagcccttcagactaacagtggatgtctcagtggaaaacctacaagccagaagagattgggggtcaatactcaacattcttaaagaaactccaacccagaatttcatatctggccaaagtaagcttcacaagcgaagaagaaataagattattttcagacaagcaaatgttaagggaatttgttaccaccagacctgccctacaagagctcctgaaggaagcactaaatgtagaaaggaaagatggttaccagccactccaaaaacacactgaagtactcagaccagtgacactacagagcaaacatgtaagcaagtctgcaaaataaccagctagcatcatgatgaaaggatcaaatccaaacataccaatactaaccttaaattgtaaatgggctaaatgccccaattaaaagacacagagtagcaagctggataaggaactaagatccaatggtatgctgtcttcaagagaaccatctcacatgcaatgacacacataggctcaaaataaaaagatggatgaaaatctaccaagcaaacggaaaacataaaaaagcagcagttgcaatcctagtttctgacaaaacagactttaaatcaacaaagatcaaaaaacacaaagaagggcattacataatggtaaatggttcaattcaacaagaaaatctaactatcctaaatacatatggacccaacacaggagcacccagatttataaagcaagttcttagaggccttcacagagacttagactgccaggcaatgatagtgggagactttttaacaccccactgacaatattagacagatcattgagacagacagttaacaaagatattcaggacctgaactcagcactggatcaaatggacctggtggatatctacagaactctccaccccaaaacaacagaatatacattcttctgatcaccgcaaggcacttactctaaaatcgaccacataatcagaagtaaaacactcctcgacaaatgcaaaagaactgaaatcatgacaaacagtctcttgggccacagaagaatcaaatttgaaatcaagattaagaaattcactcaaaaccatgcaattacatggaaattgaataacctgctcctgaatgacttttgggtaaacaatgaaatttaggcagaaatcaagaagttctatgaaactaatgagaacaaagatacaaagtaccagaatctctgggatacagcaaaggcagtgttaagaaggaaatttatagcactaaatgcccacatcaaaaagttagaaagatctcaagttaataacctaacatcactactaaaagaactagagaagcgagagcaaacaaatcccaaaactagcagaagacaagaaataacaaaaatcagagctgaactgaaggagacagagacatgaaaaacccttcaaaaaatgaaagaatccagaagctgttttttttttctttgaaaaaaagtaataaaatagaccgctagctagacgaataaagaaggaaagagagaagatttgaataaacacaatcagaaatgataaggggaatatttatcactgaccccacagaaatacaaacaaccaccagagaatattgtgaacacctctgggcacataaactaggaagtctagaagaaatggacaaattcctggacacacacacctccccaaggctgaaccaggaagaaactgaatccctgaacagaccagtaatgagtttggaaattgaggcagtaataaatagcctaccaaccaaaaaaatcccaggaccagatggattcacagctgaattctaccagatgtacaaagaggaactggtagcattcctactgaaactatttcaaaaaattgagaaggagggactcctccctaactcattctatgaggccagcatcatcctgaaaccaaaacctggcagagatacaacaacaaaagaaaacttcaggccagtatccttcatgaacatcaatgcaaaaatcctcaacaaaatgctggcaaactgaatccagcagcacatcaaaaagcttatccaccacgatcaagttggcttcctccctgggatgcaaggttggttcaacatatgcagatcaataaatgtgactcatcacataaacagaactaaagacaaaaaccacatgattatctcaatagatgcagaaaaggcttttgataaaattcaacatcgcttcatgttaaaaactctcaataaactaggtattgaaggaccatgcctcaaaataataagagccatctgtgacaaacgcacagccaacatcatactgaatggacaacagctggaagcattccccttgaaaaccggcacaagacaaggatgccctctctcaccactcctattcaacatagtattggaagttctggccagggcaatcaggcaagtgaaagaaataaagggcatccaaattggaagggaggaagtcaacctatccctgcttgcagatgacatgatcctatatctagaaaaccccgttgtctcagcccaaaggcctcttaagctgataaacaacttcagcaaagtctcagggtacagaatcaatgtgcaaaaatcactagcattcctatacaccagcaacagtaaagccgacagccaaatcagcaatgaactcccattcacaattgctacaaaaagaataaaatacctaggaatacagctaactagggaggtgaaagatctctacaaggagaactacaaaccaccgctcaaagaaatcggagatgacacacaaaaaaatggaaaaacattccaagctcatggataggaagaatcagtattaaaatgggcatactgcccaaagcaatttatagattcaatgctattcccattaaactaccattgacagtcttcacagaacgagaaaaaaaaaactattttaaaattcatatggaaccaaaaaacaaaaaaagcccgaataccgaaggcaatcctaagcaaaaaggacaaagctggaggcatcatgctacctgacttcaaactatgctacaaggctacagtaacccaaacagcatggtgctggtacaagaacagacacatagacaaatggaacagaacagagaaccgagaaatgagaccacacacctacaactaactgatcttcgacaaacctgacaaaaacaagcaatggggaaaggattcccggttcaataaatggtgctgggataactggctagccatgtgcagaagatgaaaaccggctcccttgcttacactatatacaaagattaactcaagatggattaaagactgacatgtaaaacccccaactatgaaaactctgaaagacaacttaggcaatgccattcagggcataggcatgggcaaagatttcatgatgaagacgccaaaagcaattgcaacaaaagcaaaaaattgacaaatggggtctaataaaattaaagagctgtgcacagtgaaagaaactatcaacagagtaaacagacaacctacagaatgggagaaaatatttgcaaactatgcatctgacaaaggtctaatatccagcatctataaagaacttaaacaaatttacaggaaaacaaacaatcccataaaaaagtgggaaaaggacatgaacagacacttttcaagaggagacatacatgcagccaacaatcatatgaaaaaaaaaggtcaacatcactgatcattagagaaatgcaaatcaaaaccacaatgagatcccaactaatattagccaaaatggccattattaaaaagtcaaaaaataacagatgctggcgaggctgtggagaaaaaggaatgcttatacactgtctgtgggattgtaaacaagttcagccactgtggaagacagtgtggtgattcctcaaagacctaaagacagaaataccattcaacccagcaatcccattactgggtctacacccaaaggactaaaaatcattctgttacaaagacacatgcatgtgtatgctcattgcagcactactcacaatagcaaagacatggaatcagcctaaatccccaacagtgacagactggagaaagataatgtggtacatatacaccatggaatactatgcagccgtgaaaaagaatgagataatgtccttcgcagggacatggatggagctggaggcccttatccttagcagaccaacacagaaagagaaaaccaaatactgcatgttctcacttataagtgagagttaaatgatgagaacatatggacacatagaggggaacaacacacactggggccttttggaggatagagggtgtgaggagggagaggatcaagaaaaacaactaatgggtactaagcttaacacctgggtgatgaaataatctatgcaacaaatcccctatgacacaagtttacctatgtaacaaacctgcacttgtacccctgaacttaaaagtttaaaaaaaaaaaaaaaaggagttagtggctaataaactctaaataaagcatttcaaacttaaaagcaaaatctagccaggtgccgtggctcacgcctgtaatcccagcacttttggaggccaaggcaggaggatcgcttgaggtcaggagtttgaaaccagcctgagcagcaaagcaagaccccgtttctacaaaaaaatagaattaaaagaaaagttagttgggtggagtcatgagtgcctgcagtcccagctactcgggaagctgaggtgggaggatctcttgagcccagcagttcaaggctactgtgagctatgatcacgccactgcactccagcctgggtaacagagcaagaccatgtctcaaaaaaaaaaaaaaaaaaaaaattcatcatttctaattttgcctcttccaagaatggaaggaaattaacctattcagtactgttttttctcttgaaaaataccagtcagttgttaggctcaaaaccctttgatagaacatatccatatcactggccccagggtgctcttgggcatattggaaatccactcacttagctcagctgtggattagctcaactcttagttacgagaccagaacatgtctgcatcctcacctccttaagcctgcagctcatcagaaccaaagaccctggcagagtttggtggtagttcttttttgtcagacttacagtcaggggttggtgggtttgtgggtagctccattctagtcctgggctttaatctgtgagtatggcttttgtcttccatcttgctcagggtactttggaaccgctatacattgcaggagcttagcttctggttaccatggtttgcttccagagcaacaagcctagtacttcaacatggagacaattatcttttgtttttgttttgttttgtttgttttgtcttggccatgcctttttgagtttacctttttatattttgtccatcattgccatgtgtttggagcagtgggcgttccataacatgaactcactgtaccatcacgaatgggaagtaaggggaaaccttatccatgtggattttactcttccctgattccctaaattgggtttgcaaaatactactgtgcactttcttgatgattcgggcttatctttatgactgtctgtttttgtgtcagactgtaaagaagtataaaagtctttagcttgattaatgcaatccacgcttcctttctggaaaaaaaagggggggggcgcgcatttttttacagttgcaataaatcgtcttaagccatgttggtgtatatcatatagattagtagtggtgttctagcttactttctgtgtgggcaggcaggcacggtaatttatcccctgcacgactaaagatcacaagggctaatgctgtgtaaaactgtgaactcagtgaaggtttttctctgttagccccatctttctccatggtctacccactgatggtggccactccctccaattcaggtactccctccaattcaggtactccctctcaccatctgctttctaacttcctctctgatgccttgactgaggcagtgtcgtgtcacaggaagagcacaaacttggaatgatctgggcttgaattccatctctgacttttactagcctgggaaattgtgggaagttgctttctttccttgagcctgtgttcctacatatgcaaagtggggctaataaatgccagctagctgaaaaatctatgatgaagaatgaatctatacatgtgtataaagtgtgagcagcacataaaaaaacactcagtacatagtagttgtttatcattgttgacaatatcactgcttgagagaagaggaggaatcagggctaggctgtgtgtttgacaggaatcaacattctacttagggggaagcagcaaatttatgacaggcagaattggaaaagtatgtgaaaatgttaggggtcagagagagtaggcaagttgtgaagcacagatatattggcaagacatctgaacttctaggccggagggttcctggataggaagttggcttggggttttggcagtccgaaggctgagagctgaaagaacagaatggtcagggaacaggtcagagagccagatgagaaaagctgagtctggagagttttagggagagtggtgtggtaatgaaggtgtgtagaatcaatgagacaggcaggcagacacccatgctcgtgatgatgcatagttaaggtggagcacatacttccacatctaacttcaccatctcccaaaaccccactggaactgctacaaatgtgatttttgaaaggattagaaggataggagtgaagatgaaataaaaagggttgaagaacaggaaaggaggcaacaactaaattttggatgctgaagaacagatggatgagtggcaactgacttagcagatccaagaaggccacaaactaggaattctgagaccttagtgggaaaagcaaaaagctaacttgatttactcctcacccccaggaatcttcaaaggctggaccaaggtaactctggaagtggagttacctctggaagtgaaggggggtgggtatcaaaataatgaaggctgtttgaaaactcttttaagaagtagattcattgccaaatcccctcctgctgtcaatgccagtgaggggctggcccttccctgctctgacagaagcctggagtgttattccctggagagggtaaagcagagggtctctggatggggagttcgcagacttagttgagggctggggtcctgtactgaaaacaggggtgttgagtggaagcatgtgtcctgaaagctgtgaactcccagtcttcttccctgcccctgcccctaaacttctggcagctggaagagtcttctgtgagccatctgaccaacctaagagaaaaagatctaaggagactcacactgaaggctccccagtaaagggctcactcagctgggttactccccgatgaggtacatatcttgatactgtgaggaagaagacacccattcaattgagggtacttatttttggaataggaggagagacctgagcattttagttactgcaaggaaaggagccaggcagagaagacggagagattagacattcttgagagaagaggtaattgatggagtgaggcacctggggaggcaggatgggatcgaacccagagcaggagtggaagtgacagcctgagtcagaagaaagcaccttcatctttcactgagataggatgaaaagaaatgagatctggttatagactcaatttgatccattattattttgcagccactatatccaaggcgttgtgtggggtagtgttcattcatccatccactcattcatccaacattttttggagcaactactgtgttccggcactgtgctgcgtgctggagataccgagataagtcagacaaggttccagtcctcaaggagctcacagtcacaggacgaaagcaggctcacaacatagggcaatatgtgctgtgaaaactgagcacagggggctgtgagaacacggagcaagggacactgtagagaagggaatgaagcaggtatggaaatggatatagaacaagacatggactgctctgtgcattcaagggcagagagatctcatccagcagggcccatctgcagaggtttcatgaagttaggtggtctttgagttgaaaccgagaggatgcctagggtttctttcaacctgcagtgacgtgggggtggggaacgggtgcccaccaagaggtgaaaacagatgcaaagatccagaggcaggaaattgcaagaggacatgttcagggtagagggagaggccctggttgagcacctgagaagccccggttgagagtatgctgaggcaagtggtaggaggtgcagttgtgaagcaggaataggatgagatgcaaaaaatatcactgaagcaacatcacaaattgcagccgggttgaacaaatggattgtgtaaaaaacaccagactgtgaaatgagaaacccgattctgtttgaggcccagctctgaaacaaacttgctcttgatgtggtgtgtagtgactcagttaatgtctctgaacattggtttcttcatccatcaagtggtagcaggaacacctttcctgcctgtctcatggggttctcgtgaggagcatataagtcagtgtacgagaaaacacctttaaaacaacaacaacaacaactctttaaagtgccggtgcacacacgtgaaggcttattattgaggagacgcttgtgctgggaacacaaccctaaccctaaccctaacccctaaccctaaccaggggagcaaatgtactgaaatattctcctaaagggatccaacaacattccgaaactagttgttaggtaacatggggagcgaatcaactcctgttaatttggaatgtctatatgtcaaatttacatacaataaaaatagatttgtactatcctggcggtctaccgatgatagtacaacaggaattatacacacaaaaacatgcaaatgtccgattgttcttcattcactcaaccaacattcattgaccattctgctgtgcactgagggcaggcacgctggaggccagacaaatagaatttctgccctcaagatctccttgtaccacgggagacacatgtattaacagccaatgttaacaccaggtaagcacaaggagtctgtgggagctcagaacaagggtacctaaaccagtcttttgcagctgaggttgtattaatatgaagtagtaccattgccccgattttacagatgaggaaactgagagttagagagcaagtgacagagccagtactctaacccagctgttttaattctgaatccagggctttttctgtctcgccacagctgcctcttttgctttgtaaatactttaggtctaatgcatatggcaaaagataagttgtcttgtgtgtccctgcccatcctagactgcctgctcctttccagagacaaacaggaatttgggggttagagcacttccgtgtgtccaaaatgttatatttcagatataagtaataataataataattaataattaatagtaaaagtcctcaccctatctataagttccttttgaaagcttctcaagagtccaggagtgtgtgtgcacacacgcatgtacgtgtgggtgtatatgtatgcacgtgtacgtgcacgcatgcaagtgggtgcgtgtgcataggcgtttggagtagggaaggttgggaagcactggctcctgcattttcaacaaacctggatacagagaaaatggaaaatgagcccaaacaaaaaggaacttgcagaagaaggcaggtgaaaataaccaatgagagaaaagagttctcaggagacaccaggaaagcagtgtctgctggccacatctactgcttcactggcagttccattaaaataaaatatattccactaaaatatatatagggaaagtggtttcctccatcatgttcttctgggaattttgtggaaatttcctgacgttgtgtgagtcataaaaggaaaaagaaataatttccatttctggaaatattgcagattacataacccgaaatccctccttgctacacaacacctaaaaaagctgggtaactagtggtctgtggttgccaaaaatgacatcctgtgaacatccgggagcctcaagcaatcccaacgctacggcaactgaaaaaaaaaaaaatgaagggattgcactaagtagctcgtaagatccctttcatccatttctttgcaccatatcattctttagttcttgtattcactcattcactggaacatttactgagcactgattctatatcaggtattggctgcgttgtgttttgatgaatacaaagttgaaaggcatggtccctgtattcaaatagctcaccacgttgtgcagtggctcttgaccggagctgcacatctgaatcacttgagaaggtttgcaacaatgcatatgcctgccttcctcgctgccctcaagattctaacttcatcctggagggaaatgaatagcccggcattctttctgtgttgatttctgaaacccagagcctgaagggaattcaaagtgttagacagcattctatagaaatatgaaagggaaaggatttcttctggacaggatagatcctcaagctcgggggaaggtgcagaagaggcgagacctctgtcatttccaagaggagtgggaacctgggccctgctgcccgacagcaatgccaaggagagacgtggattgatttgagaggcattttgaaggtagagtccactgaacttggtgtccaattaattgcgagagaggggttgagggagaggaagttgtcaagatgactcccaggttactggtttggtcaactgggcacaccttattcacacagggaatattagaagaggagagagcttggagagaagatgttttcagtcttggatatatttgagtttggggtgcatgtggaacagaacatccaggcagggaagtccaagaggcaattggatactcttacctgaagcttagcagagtgttcaaccttgtatatcattttaaagtgattgcatcactcccaaccctcttaaaaactttctgagtaaagcataataccaactttatacatttcctttcaaagagcacacaaaaaaaatcagttctttgtgcctcagggaagagccacacccagttacctatataaccatattttgagtaccacctcgtgacttttctgcagccttcagtacctgcttttaaatggtcacatataataaatgcactaaaagcagccatgtctcaccaccgtttgcttagggcaggattcccatcagcaatggatcttcatatttttccacttctgagcctagggaagaaaaatccatgaaggtaaccagttcataaagtggctcttcttcccaaaatttcttgtgacatgtggctttgagcaattagggctctttcaacccctaggcccttcctcactcatcttaagctgtcattgagtgtctggcaccccaaagcaccaatctttctttgaggctacatattcatgaaaagtcttcccccgcccccatcacattcctcttccagagaatttgtgggagcttcttagtgctctgggagttttaaaggggaaagcaatttccatttctggaaacagtgcacactagataacctgaaaaccctcctgttacaaagcaccttttaaaaggcaggataaaatttaataaatattccttttaatgcacatgtgatgaacttatggtggaagttgaccctcaggtgtcaaaaaacaaagaggaacctaaagagcagatcaatgggcatttgaatttatgttagggtggtaggggaatggattcaataaccaccagggagaggagaaaagccttggtgcctcacaagggctacacagtcagtgaaaggatggactaggaaaaaaaagtcttcccaccaccatggtgagatgacaagagagtttgtttcttcatgggttctggtgggagaaaataaaatgcttcccctggtcatttgtaactctaaggctattgtcatgtaggtctagggttggaattaatacctcttatttaggtcttgaaaaccccaagcttacacattaacatcaaaaagataacagccagagatacacccccagtcaaacctcattgaagtcacacagatgaagccgtttgaacaaatccctaaactcacaaacaaaattataaaacacctgaggaaaaaaaaaaaccgcctgtgattgagtatcagcaaacacaatgatgagcaggattacactaccaaaaactttagataatagagccaaccgagagtataaaataagtttgtataagatacttagaaacaataaggaatccaaacatatgagaaagatcaagattctacggaaaaagaagaggccggtttctttctttaaggaaccaaatagaacttccgaaaatgaaagacattatttccagtgacagcaaaagatcagaggatgggtttaaaagcagattcatctgctttagtgaactggaagatagaagtaaggaaattattcagaaggcagcaaggagagatagcaaatgtataaacggttaagagatacagaaaaatgatgcaaaggtccaaaaaaactctaataggaatgacagaatcagagaataaagagagcaggggtaaaccaataatcaaaaggatactggctggaaattttcagatttgaaaacagacatagttcctcgtattctaaaagcatgagccacagcaagaatcaataaaactgaatcacaggggaaccggcgcaggtcaacaaagaaaaggggaaagatcttaaaatcaaccagaaagaaaagacacagtgctatcaaagggataataaactgacagcagacttctcaccaactgcaataaaaatggaatcatatcactaatgcattcggggaatggggggaaatgtcatacccaactaaactacaattcaagaatgagtgaaataaagatagtctttttgatatattttaaaatatttatttatttatttgttgagacaaggtctcactctgtcgcccaggttggggtacagtggtgcgatcatggctcactgcagcctcgatctcatgggctcaagggatcctcctgcctcagcctccctagtagctaggactacaggtgtgcacctccatgcctggctaattttttttttttccccagtagctgggactacaggtgagcaccaccactcccggctatttatttatttatttattattttgtagagacaaagtctcattatgttgcccagcctggtcttgaactcctgagctcaaatgatcctcccacctcggcctcccaaaatgctgggattacaggtgtgagccactgcacccagccagtaaagatattcttcaacaaaggttgagagggctgaccactcacaaaccctcactgaaagaacgacttaaagatgttcttccattaaaaggaaattgaacgaaaagaacaaagcaagatgcaacagaggaatggtgaacaaagaaactagtaaccatggccatgagtccaaaaaaaaaaaaaaaagactgcataaaaacaatatgactgaccaaattataactaaatactggacagcactgacttgtaagacaaggtccttgcattgtttgcggtgaaattggagacgattaagatttgataaaatgaagtgtttgcgattaaaaataaaaagaccttgataatttcatatccgttagtgtggattcagatccattagaaagcttacatttatctaaaactaactccaagtcagccggaatatatcccaggaataaaaaaataacccttcaaaaccagagattttgtaactgaactccggtccaggccattcatcacctgaaggccaaaaactcaaagagaggagctttggtgaaaggaaagttagctttatttgagaagccagcaaccgggaggagtcagtgaactagacttcagtgatcacctctctgagttgtgcctctggattagggttttttaagggaaagcagaggaaataatgatcaaaacattcttctaaaacgtgttcagtctcaggtgggcagttaatcactgctttcttggtcagtgttttgtgaccttccacaggcaccgtcagcctattcttaccaggctggtcagccccttcccagagctgctggttggcgtgttttcttttatctctgttgaaggtcctgttttcctgagactatttttagtgaataatctacaaactcaagcaaagcaataatcacattcaagcaagcaaacttttatcttaacttggagtcagtaacattacaatttatttgtaaaagatggcagagtgaagaaagataaaagaatctcccttccccgatcctactaaataaattaaaaaataatacataaataatggtaaaaagcagaatgagaagaagagaagactaaggaggagaagaagagaagactaaggaggagaagcaggagaaggagggagagagggaggaaagtggcttcccaggaatatatatatatatatttatatgaatatacatacatgcattacacatgtatgtatatctacatgtatattatataagtatttatataaatacatgtatattacatatatagatacaaatataaatacatgtatattacatatatatttatataaatatacttacatgtatattacatatatatttatataaatgtacttacacgtatgttacatatatatttacaccaatatacatacatgtatgttacaaatatatttatataaatatacatacacgtatattacatatatatttatataaatatacatacatgtatattacatatatatttatataaatatacatgcatgtatattacatatatatttatataaatatacatgcatgtatatttacatgtatttatataaatatacatgcatgtatatttacatgtatttatataaatatacatgcatgtatatttacatgtatttatataaacatacatacatgaatatttacatgtatttatataaatatatgtctatctatttatataaatacatgtatatttacatgtatttatataaatataaatacatgcatatttatataaatataaatacataaatatacatgtatatttatataaatataaatacataaatacacatgtatttatagttatataaatacataaatatacatgtatttatatttatataaatacaaaaatatacatgtgtttatataactataaacacatatatatttatataactataaatacatatatatttatataactatagatacatatatgtttatataactatagatacatatatatttatataacgatagatacatatatatttatataacgatagatacatatatatttatataacgatagatacatatatatttatataacgatagatacatatatatttatataatgatagatacatatatatttatataacgatagatacatatattttacatatatatttatatatatttatataactatacatacatacatatttatatatatttatataactataaatacatacatatttacatatatttatataaccataaatacatacatatttatatatatttatataactataaatacatatatattgatataactatcaatacatatacatatttatataactataaatacatatatattcatatatatttatataactataaatacatatatattcatatatatttatataactataaatacatatatattcatatatatttatataactataaatacatacgtatttatataactataaatacatacgtatttatataactataaatacgtatatatttatataactataaatacgtatatatttatataactataaatacgtatatatttatatataactataaatatgtatatatttatatataactataaataagtatatatttatctatgtatgtaactataaataagtatatatttatatatttataaaactataaataagtacaaatttatatatttatataactataagtaagtatatatttatatatttatataactataaataagtatatatttatatatatttatataactataaataagtatatatttatatttatataacaataagtatatatttatatacatttatataactataaatacgtatatatatttatataactataaatacatatatatttatatgtatttacataactataaatacatatatatgtatttcactataaatacatatatatgtatataactataaatacatatgtgtatttatataactataaatacatatgtgtatttatataactataaatacatatatgtagttatataactataaatacatatatgtagttatataactataaatacatatatgtagttatataactataaatacatatatatgtaactataaatacatatagatgtaactataaatacatatatgtagttatataactataaatacatatatatgtaactataaatacatatatgtgtagttatataactaaaaatacatatatatgtagttatataactataaatacatatatatgtagttatatacctataaatacatatatatgtatttatataagtataaatacatttatatttatatatacatatttatatataaatatacatatatgtatttatatctacgtatttatatatacaaatatatacgtatttatacatacaaatgtatacgtatgtatatatacgcatttatatatataaatatatacagatttatatatataaatatatgcacatttatatataaatatatacatatataatatatgcacatatatacacatatgtatacatacatacgtatatacatatacatacatatatacatatacatatacatacatatatacatatacatacatatatatgcatatatataaatatataggtattcatatatacatgtatattatataggtgtttatatatgtatttatatatgtattatatatagtacatatatatgtattattgtacatatatatgtactatatatttatagtacatatatatatatgtataaattcttgtggggaggatggctggtttagcacacttctcattctgtccccaccccctggaagcaatactgaggaaaaacaatgtgagccagtcagatcctgagaatgggatgtaaggctctctaacttgaggagaaatggactgagagaataagcagaaaaaagtaaatacctttgtgaacagaagccctcaactgccactcctagatttcaccagcggtaggaaggctcccaattctttccattttccaagacaccgtgctgagttgggcaaacaaaacaaaaccctcagagtaagacacacccttgcatggatggactagagcatgatacatgatatttagcaagatcttagaagaaaaggtagattgaaatcaacatcccacctgccctcaaattatcaccctcagaatgttagagcaaatagaacgtctgacaatgttttccataattgaaataaaaataaatggtttagcaatgatgctaacaatctacagggatagagggagagggaaaaggagggaagagaggagagagagagggagggaggaaggaaggaagaaagaaggaagaaaggagggaaaaagagaagaggggaggagggaaggaagaaaaagaagaaaagaaataaggaaatagaaagagaaagaaagaagaagaaagaaaaaagaaagaagaaaggaagaagaaagagaaagaaagaaaccatcatagtatacaaaagacagataaccatcacagactggaagaatgcataaaacaaggaacagatgcaactaaccctagagttctctaagccatagtaaaatttaaaatatgatttcaacttaacaaagtttcaaagaccagatgattggcaaccgaatatgatttttttttttttttaaaaaaggagattactgagctcagaaaagaaaccgagaactcaaagaaccacatggtggatcaaagaagtaaattaggaagagcaagatgcagaagagacatgcacacaaatcgaaacaagggcatggaggaaggactttagatggtcacgctaatgctgatccaacattaagataatttacatgccttaagtaaagagcctaataaatgggatagaaaaatatccacagatgccatatgtgaaaagtttccagaaataaaggaagaattgaacctgctcctcaaaacgacaaagtctctaccatcaaaaattgatgcagaacaatcaatattgagatatattctagttgtgttatggtacttcaaaaaaaattaaagaatttcttaaattctttaaattaaagacacctaagcacgtgcgcgtgcacacgcgcgtgtgcacacacacacacacacatcaattacttacaagggaacaaatttgttccacttaaatataaaagtaaaatgtaacatctccagaatgtttctgctcctgggtgagatgaagcatgcacactctactgaatgcagctataaaatgtggacacagtgcatgggccagctatttgaggactctgaaaagtaaatggaaggaggcagaccggggaaagactacaatttgaagcaccactgaaacagcagtgaatttgacattttcccccctttagtatccttggctcaacgtagcctgcaagttagaagtagacagtggtgtgaacagagagagctctggttctgacttgagaagagggaaaagggaatactaaccctcagcgatagttaagggaatccccagtttttctttcttcttttctttgtactttcatgttctagcccacaggcaatcctgtggcagcagtggtggtgacagaggcagtgacagtgacagtggcagccgccagggccttcaggtgattaaagctctgaaggaaagtaaccttcctctctgattgtaggtcccaaaggggtgcccgtgacttctttttcccctctttggtcttcctgccgaatcacaccagaggaaggcaaaggcacaggaagcgtgtggcagagaagagtcactaaagcgacagcaacagcttcatggctacaaggttgaaaaggggaagctgagggaagcagaaagtgctggggagattgcagggagggaggaagtgcttgggaaagtaaacccatgaagctgtgtatgagcttctgggcttaccccacaaggtgtgtatgtacagatgtgatcctgtacgacatacaaaggactttgagaactgcactgagtaagggatatagacctcgccagctccaagactgctgatcatgcttaacagaaccaaataccattgcaaaggctttgaaatggaactaacaataaaacccccggtcagaacatgtggcctgagcctaagtgactgggggaaaaatgagtggagacttggggatctgtgggaatatgacaaaagagctaccttttgtgtcatcatagtgacagaaggaaaggaggaagggggtgggactgaaaaagtattcaaataaataatggctggaagattctaaatacggcaaaagacacatgcctgtacatttaagaagctgagtgaaccccaaacagaataatcttaaagaaacctacaccaagaagcatcacagtcaaacttctgaaaactaaggacctaggaaaaaagtcccaaaagcagagagagagagaaaggaaaccttacctatacgggaaaaggaattagaatggcaatatatttctcattagaaaccatggaggccagaggaagtggcataacacttctcaagtggcgaaacaaaagaaccagaaccctgtctacaaagtgaaattaccttcaggaatgcaggggaaatcaagacattcgcagaagaaggaaaagtaagagagattgttgccatcagacctacccttacctctacgcttagagaagcttcctgcatgagattccactaggcatgtaaaatgccttggctgagcatgacctgctcaccaattctctctaatgtggacatttatcatgctgcccagtattgggaagatatgtcttagaatttctcacgagctcctagtacaagtctggtctagtttctgcctccagcccctccactgaaattgctcttgccaaggcccccagcaacacttgcattgcttaactcagtgaacaggttttaatgcttatcattttggaactcagcaagtgtttctgagtttgtcccttcttcttcagttcctctggcttccttctgcacctttgctctcatctctttctggcttgattatcttttagcgtgcccccccaccccgcaccaactttatctgtggagacactcctctagtcttcttccaatgatgttcctcttttgcttgccccttaaaagaagttgtccttggtccccttatatattctatgtgctctccctgaatggtctcaactacattcatggcttcaagaactaccctgatgagtcgcaaatctgtattttcagtattgacttcactcctgaactcctaagccaaatctccttcatctccatctggatatcccacaggcatttcaaatttcacacgctcaagactgaactcatcttcctacccatacgcagacctcctccttcatcccatttgtccaggaatgactccaaagtctgtggtcacctcactctatccctgtggagtcatgctagagctttttcacttccccatcgccactcccctcccctgccaaccaatgccccgcttttccaattggctaacttgtactcgttcttcaagcttcatattggacaccatttctccaggaacatttccccaaccccaaacgtctgtgtaaagtactcctcttatgtgttcctacagcactttcttagtccatctgtgttgctataaaggaatacctgaggctgggtaatttataaagaaaagaggtttatttggctcatgattctgcaggctgtacaggaaacatggtgctggcatctgcttggtttctggtgagggtctcaggctgcttccactcatggcataaggtgaaggggagccggcaagtgcagagatcacatgatgagagaggaatcaaggtggggtgggggggaggtgctacactcttttttaacaaccagctcttgtgggaatgaatcaagtgagaactcactcattactgcgaggctggcaccaagccattcatgaaggatccaccccatgactcaaacaccttccattagaccccaccttccaacactgggtatcaaatttccacatgagatttggaggggtcaaacaaaccaaactataaccagcaccttgaacttcccctctcatagcacttatcacagtatagtgttgtcattgtctggctccttgtctgtatgttccgccagactgcatgcagggatctgatctatatttctcgttggtgttgtctcaatgcttaacacagtatacctggcactacccttcaatattttttgaagaatgagcacatgaattatcatgtctccagctaggttcgccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcagtgtatataatacaccatattaatggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacattgtactcaaagttctagtcagggcaattagtcaagaaaaagaaataaaaggcatccagatcggaaaggaacaagtaaaaccatctctattcatagatgcatagatggcatgttcttatatagaggacactaaagagtccaacaaaagaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagccgtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcgggggggggggggggggacaacagtccagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcaccagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggccgggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacccaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggattttttttttttttttccccccccgagatggagtctcactctgtcgcccaggcaggagcgcagtggcgtgatctcggctcactgcaacctccgcctcctgggttcaagcgattctcctacctcaacctccagggtgcctgggattacaggcgtgcaccaccacgctgggctaatttttgtatttttaatagagatggggtctcaccatgttggccaagctggtctccaactcctgacctcaaatgatccaccctcctcggcctcccaaagtgctgggattacaggcatgagccaccacgcctggcctgtaatagggattttgctgcaacttttagttaagtaggtgaaatcagagtgcgtggccctttggtgttgtgcgatcacgtgactgcaaggcagcctccgtgttcccccaaagcaggatggcgttccgtttgagaacacttaagtttccaaggctttctgcctcaaatggagcatgccccccaactacgctgttttcttatttattgcgtctttttaatccttttgatggtgacaacaagaactcttcagaatatagcctctttctcaaactttcaaccctggggaaatgcatcctttgggccgaagttgcacacaatcctgatcttcggggctgagatgtaaggacacagtttggagtaggtgtttttgttttgcgtctttttgcaggggagaggtgtggagggttgtcactgtgagttgagtgcctccaaatgggtgggacttgtagggtgttcttttctgcttctatttctatttcgacagtgtggaagtaatgggaagcacaggagaggcccattccaccatcattcctctttctctcacttggctgccaggaagggtcctacggagccctgaacgcctagcccaaattattgtaaaagcggttgaagggctcatgctcttttgctctttggctctttcctggtatgctcctcttaacccgggctgcagacctggccggctggcttcttgtcaggttcaggagttacggagcatgactggtgaccagtttgggatttgggcttcaggagaagcctccttaggcctctggtccaaactccttgcgtcagggaggtgaggggaaggataaccagacggtcaggtagtgggtatctgagcataattctaggaaacactaaaactcctcgttttccatttgccgtgggctcattcatgtatctccctcagaagcttaagagcagtgataactgggccgaggccagatttcagcagttttgagaattccctcgtaatgtatcacatcagtatcaaaagtcaacactgatttctagcatgccaaaagcaaatactttcagaggacatgattagtttgctttttaacttgaaaacaattccaaattcacacttaaaacagtgtaaaccgtcggaaatggtggcagcgaagcagtgaacccttaaaggctgttggggttccccttctccccattgtgaggtactcccaaaaggataaatgttgcttatgaaagaatattttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcaataactgtttaatttttttttatttcaataacttttggcttacaagtgctttttggttaaatggatgaattatatagtggtaaattctgagattttagtgcacccatcacccgagtagtgtacattgtacccaatatgtagttttcttatcccacaccctcacactcttcccccttgtgtgtctccaaagtccattatatcactctgtatgtctttgcattctcatagcttagctcccacttacaggtgagaacacagggtaatttggtcttccattcctgagttacttcacttagaataatggcctccagctccatccaagttgctgcaaatgacattattctgtttctctttatggctgagtagttctccacggtgtgtacataccacattttctatatctactcattggttgattggtgcttcggttcgttctatatctttgcatttgtgaattgtgctgaaataaacatatgtgtgcatttgtgtttttcatataatgacttcttctcctttgggcagatacccagtagtgggattgctggatcgcgtggtagatctacttttagttctttaaggaatctccatactgtttcccatagaggttatacattcccacctagcagtgtatgcaccgtcccttttcaccacatccacgccaacgtctattgctttttgactttttaataatggccattcttgcaggagtaaggtggtatcttattgtggttttaatgtgcatttccctgatgattagtgatgttgagtattttttcatatattttgtggctatttgtatatcttttgaccaatgtttattcatgttatttgctatttgatgggattatttttatttttttcttgctgatttgttgcattcgttgtagattctatatactagtcctttgttggctgcataatttgcaaatattttctcccattctgtgggttatctgtttactctgatgattatttcttttgctgtgcatagtgttttagtttaattaggtcccatttatttttttttctgtttcatttgcttttggggttttagtcatgaattctttctctagaccaatatccagagacgtttttcaaggttatcttttagaatttgtatggtttcaggtcttaaatttaagtctttgttccatattgagttgatttttgtataaggtgaaaaatagggatccagtttcattcttctacatgtggctagccagttttcctagcaccatgtattaaatagagtgtcctttctccaatttatgtttttgtatgctttttttaggattagttggttgttaagtatttggctttatttctgggttctctattctgtcccattgttctatgtgcccacttttataccagttccatactgttttagtaactatagccttgtattataaattgaagtccagtaatgtcatgcctccatatttttcttttaaattatgattgctctggctatttgggctctttttggttccatatgaattttaagattgttttttctaaatctttgaaaaacaatgttagcattttgatgggaaatgcattgaatctgtagattcctttgggcagtatggtcattttcacaatattgattcttcaaatccatgagcataggatgtgtttccatttgtttgtgtcatctatgatttgtttcaccagtgttttgtaattctcctggtagagatttttcacctctttggttaagtatattcctcggtattaaattttttgcagctgttgtaaaagagattgcgtttttaatttgattttcagcttggtaattgttggtgtatagtagtgttaccaatttgtgtacattgattttgtaacctgagactttactgaacttgtttatcaaatctacgtgtcttttggagaagtcttctaggtatatgaccatatcattaacaaacagtgataatttgactttttctttttaaatttggatggcctttatttctttctcttgcttgattgctctgggtaggatttccagtactatgttgaatagaagtggtgaaagtgggcgtccttatcttgttccagttctcagggggcatgctttcaccttttcctattcagtttgatattggctgtgggtttgtcatatatagctttttttttttagacaaatcccttctatgcctattttgctggggggttttatcataaagcgatgctggatttcatcaaatgctttttgtgcatctattgagatgatcatatggtttttgtttttaatcctgtttatgttgtgtatcacatttattgacttgtgtatgttaaaccttccctgcatccttgggatgaaacccagttgatcatggtgtattgtatttttgatgtgctgttggatttgtttacctagtattttgttgaggatttttccatctatgttcatcagggatattggtctgtaattttcttttgttgttatgttctttcctggttttggtattagaatgatactggcttcatagaataatttagggaggatcccctttctctatcttttgcaataggttcagtgggattggtaccagttcttctttgaatgtctggtaaaattcagctgtgaatctatctggacctgagcatttttggttggcaatattttttttattactgattcagtctttctgcttgtgattggtctgttcagggtttctctgtattccttattttgagacagagtttcactcttgttgcctaggctggagtgcaatggcaggatctcagctcactgcaacctccacctcccaggttcaatcaattctcctgcctcagcctcccaagtagctgggattacaggcacctgccaccatgcctcattaatttttttgtatttttagtagagatggggtttcaccatgttggccaggctggtcttgaactcctgacctcaggtgatctgcctgcctcggcctcccaaagtgctgggattacaggcatgagccactgctcccatccagcttccagtttaatggaatcgttgttgtgtctcctgatggcagcattcctccctctggggctaagacttctaggccagcagaatgtaatgttgcgggaacaggaagcaaaaattttgcttcactaggggtgatggtgagtggtgctacttccacttccaccccttgattcctggacccgtgaatcctggctatgggagaaacagtaccatatattggacgctgattgagagcatacatggccttctggagaactttgccccagccctgcaaagtattgtcacctagttgatgttgtaattgtaacttcaaaaggccattccaccattctatcaatccagcttcttcaggatgatggggaacgtggtaagaccagtgaattccatgagcatgagcccattgctacacttctttagctgtaaagtgagtgccttggtcagagacaatgctgtgtggaataccgtgacggtggataaggcattccgtgagtcctcagatggtagtcttggcagaagcattgtgtgccggataggcaaacccatatccagagtaagtgtccattccagtgaggacaaacctctgccccttccatgatggaagaggtccaatataatcaacctgccaccagatagctcgctgatcaccccaaagaatggtgccatattgagggctcagcgctggtctctgctgctggaaaattgggcactcagcagtggccgtggccaggtcagccttgataagtggaagtccatgttgctgaaaccatgtgtaacctccatccctggcaccatggccactttgtttgtgggcccactgggcgatgacgggtggctggggaaagaggctgaggggcgtccacagaacgggtcatcctatccacttgattattaaaatcctcctttgctgaggttacccattggtgagcactcacattggatgcaaatatcttcatagcttttgaccactcagagaggtccatccatatgccgcctccccaaatttctttgtcaccaattttccaattatgcttcttccaagaccctgaccatccagccaaaccattggctacagtccatgaatcggtatataatcgtacttcaggccacttctcctttcatgaaaagtgcacaaccaggtatactgctcaaagttatgcccactgggaagatttcccttcaccactgtccttcagggatgtcctagaaaggggctgtagtgctatagctgtccacttttgggtggtgccagcatattgtgcagaaccatctgtgaaccaaggcctagtcttctcttcctctatcaactgctcatagggaactccccatgaggccataggtgcaaggttgggggagagaaggcagggtggcaggagtagagaccgtggacatttgaaccatttccttatgtaacttacttgtgccttcaggacttgcttgagcccgattgcatatataccacttccatttgatgatggaatgctgctgtgcatgacccacttcatggctagatgggtcagaaagcacccagttcatgacaggcagttcaggcggtatggtgacttggtgacccatagtcaaacattcagtttccaccaaagcccagtaacaggccaagagctgtctcaaaaggagagtagttatctgcagaagatgacagggccttgctccaaaatcctagcggcctctgctgtgattcacctatgggggcctgccaaaggcttcagacagcaaccctatctgccactgacacctcaagcaccattggatctgctgggtcatatggtccaagtgacaaagcatctttcacagcagcctggacctgttgcagagccttctcctgttctggaccccactaaaaactggcagccttttgggtcactcgataaatgggccagagtaacacacttgaatgaggaatgtgttgcctccaaaatccaaataggcccactgttagatctgacatacagcaattacaggactcttcaaagatacaggtgctgcactcacaaatctatttctcaaggcattggtcaaggttatatcttttggaccctccaagctgggatgagtaggtctaaattaactaattcactccactatcccaatctccctaagcctttggatcccttcctctacattaaaccaagggagagcaggcatttcagctcgctcaagtgggctatcttttaatccatatttcaggtaaccaagcaaataaactattagaaccttatttaactacccgagctgcaacattaaatgcagagtccctacttagtgcacccaaatcaataaatccagcctgatccaactctatgttccttccaccattatcccacacccttaatatccattcccatgcctgttctccagatttctgttcatataaattagaaaagtcaagcagttctttttgagtgtagtgttcctcctcatgggtcacactctcaacctcacctctagaggcccactgtgactttagtctagttataggtctagaagcaaacaggggtattagggttggctcctaaggagaatcaacattatcttgcctggcaactgcctcaggggaggccatcactgttgcctcaggcagcacagggtttatctcttcaggcgaaggtggaaaggctgatggcagcatgggttagggagaggatgttgccactactggggatggggaagctgtttcttctggcaaaaaaggttcatcagagtttacatactctgtgtccccagcttcatcagggtcctcccacatgtccccattccaagttgcagggtcccattcttttccaatcaatgccctcactttaacagtagatgcctggtgaggctgtgcatgcacctttggttgcaggtcagccactcacgtgataagagcctgtgtctgtttttccacaatttcagctctttctctacaagagataacactctcactcagggcaatctcagcagatttgaggctcagtatctgtttctgaagccaggagataaaatccatgagttcattttctttcatcacgttgtccgctgaacttaggagcaaccaaccggcttcattatattccttggtcccccatataaggtcaaagatatgatgtatagagtcactaaattccttgcctctcacaaacggtgaatcaggagtgttaaatgcatttattttgcataactctctaaacagtctatgacaaggactatcagtgttctccatactattagaagtagattccttagcatttttgagtctaatcgtattaagcagccaactccagaaaccccaaaaccaatgaaagaactccatccttaatattctcttcctctagaaccactcctggtaccaaaatctgtcagggttctctagagggacagaactaattatatatacaattagtttattaagtattaactcacacaatcacagtgtcccacaataggctgtctgcaagcggaggagcaaggagagccagtctcagtcccgaaactgaagaacttggagtccaatgttcgagggcaggaagcatccagcatgggagaaagctgtaggctgggaggctaggccattctcattttttttttcacatttttctgcctgctttatattctagccatgctggcagctgatagatggtgcccacccagattaagggtgggtctgcctttcccagaccactgactcaaatgttaatctcctttggcaacacccacacagacacacccaggatcaatactttgcatccttcaatccaatcaagtggacaatcagtattaaccatcacataggctaactaaaaaatgagagaatactcaaataaatgaaatcagaaatgaaagaggagacattacaactaatcacacagaaatacaaaggatcataagagactattagaaacaattatatttcaacaaattggataatctagaaaaaaatggataaattcttagaaacatataaccaaccaagattgaatcatgaagaagttggaaatctgaatgtaccaataatgaattaagaaattgagtcactaatcactagtctcccatcaaagaaaaccccaggaccagatagcttcaccctgaattctaccaaacatttaaagattagctaatagcaatttttctcaaactcttccaaaaaaatcaaagaggaaggaatatgttcaaacccattttctaaggccagcatcaccctgataccaaaacctatcagagacacaacaaaaaaacaaaacttcaggtgacacaacaaaaaaacagaactttggtgaacatcgatgcaaaaatcctcaacaaaatactttaaaccaaatccagcaacacatcaagaagttaatccatcaagtaggctttatccttgggatgcaaggttaattcaacatatacaaatcaacaaatgtgattcatcacataaacagaactaaagacaaaaaccacatgattatctcaatagatgcagaaaaggcttttcataaaattcaacaccctttatgttaaaaagaaacaataaactaggtattgaaggaaaatatctcaaaataatatccatctatgacaaacccacagccaacattatactgaatgggcaaaagctgaaaacattccccttgagaaactggcagaagacaaggatgccctctctcaccactcctattcacatagtattgaaagtcctggccagagcaatcaggcaggagaaagaaagaaagaaataaaattggaagagaggaagtcaaactatccctgttggtagacgacatggttctatatctagaaaacctcatagtctcagccccaaagctccttcaggtgataacttcagcaaagtatcaggattcaaaatcaaagtacaaaaatccctagcattcctatatactaacagcagccaagccaagagcaaaatcaggaatacaaacccattcacagttgccacaaaaagaataaaatacctagggatacagctaactagggaggtgaaaagagttctacaatgagaattacaaaacactgctcaaagaaatcagagatgacacaaacaaaacattgaaaaacattccatgctcatagataagaggaatcaatatcattaaaatggccatactgctcaaaacaatttataaattcaatgctattcttatcaaactaccaatgacattctccacagaactagaaaaaactgttttaaaattcacatggaataaaaaaggagcccaaatagccaaggcaatcctaagcaaaaataacaaagctagaggcatcaggtgacctgacttcaaactatactgtagggctacagtaaccaaaacagcatggtactggtacaaaaacagacacatagacaaatggaacagaatagagagcccagaaataaggtcacacacctacaatcatctgatctttgacaaacctgacaaaaacaagcaatggggaaaggatttcctattcaataaatggtgttaagataactggctaaccatatgcaaaagattgaaactgaaccccttccttgcatcatacacaaaaaataactcaagatggattaaagacataaatgtaaaaccccaaactatgaaaaccctggaagacaacctaggcaatatcatcctggacgtaggaactggcaagatttcatgatgaagacagccaaagcaatggtgaaaaaaaagcagaaaattgacaaatgggatctaattaaactaaagagcttctgcacagcaaaagaaactatcaacagagtaaacagacaacttaaagaatgggagaaaatatttgtaaactatgcatctgacaaaggtctaatatccaacatctataaggaacttaagcagatttacaagaaaaaaaaggccataataaagagggcaaaggacatgaatggacacttttcaaaagatgatatatgcagggagccgaaggccccgtgggacgtgaccaactcagcattccactggaggctatatgatcaaacagcaaactgtttatgatgaatgcaggatgtgggcaaactcacgactgctcccgctgccagaaggtttgctgagggcaatcgcttcctggcacgagctccttgaggttatctactgggacatctagagaatgcagtcttgcaagcctactctggactgagcagctgactccttccttccatccccccttctcactatctcttttgcctaataaatacagagggctatgtaaagctcagggcccttgtccactagaggcaaggtgccccctgaccccttcttccaaaaatactcttttgtttttgtcttttattcctgcatttgccctctttgttcagtccccctagttctgtgcaggttacagacatacatgcagccaacaagcatattttaaaaagctcaatatcactgatcattagagaaatgcaaatcaaaaccataatgagatataataccatctcaccccagtaagaatggctataatttaaaagtcaaaaaataccagatgctggtgaggttgcagagaaaagggaacccttatacactattggtgagagtgtaaattacttcaaccattgtggaaaacagtgtggcgattcttcaaagggctaaaaacaaaactaccattcaacccagcaatcctagtactgggtatatacccaaaggaatataaatcactctaccctaaagacacaggcatgtgtatattcatttcagcactattcacaatagcaaagacaggaaatcaatctaaatgcccatcaatggcagattggataaaaaaaatgtggtacttatccaccatggaatactatgcagtcataaaaaagaacgagagcatgtcctttgcaggaacatggatagagttggaggccattatccttagtaaactaatgcagaaacacaaaacaaaatactgcttattctcatgtatgagagcaaaatgatggaaaggcatggacacaaagaggggaacaacagacactgggacccacttgaaagtggagggtgggaggagggagagcatcagaaaaaataactactaggtactaggcttagtatctgagttacaaaataatctgtacaacaaacctctgtgacatgagtttgcctacatagcaaacaggcacatgtatctctgaacctaaaataagttatttaaaaacagaaaagaagactgcaggacaatataactgatgaacataggtgcaaaaatcctaaacaaaatactaccaaaccatatttaccggtacattaaaaggatttttcaccatgatcaagtgggatttattcctgggatgtaaggttggttcaatatatgcaaatcaataaatgtgattcaccacattaatagaataaaggacaaaaagcacaggatcatgtcaataaatgcagcaaaatcatttcataaaattcaacattttttatgattaaaaactctccacaaataaaatgaatgtttctcaacacaataaaggccagccatgtataagaagcccacagctaaaattatactaaatggcaaaaagttaaaggctctttctctaagatcaggaacaagacaagaatgcttattctcaccacttctgttcaacattgtactggaagtcctagccatagcaattagacaagagaaagaaataaaagtcatgaaaatacaaaaggataaagtgaaactgtccgtgtttgttaatttcttcttcttcttcttcttcttcttcttcttcttcttcttcttcttcttcttcttcttcttcttcttcttattattattattttgagatggagtctcactctgtcacccaggctggagtgcagtggtgcaatctcacctcactgcaacctccacctcccaggttcaagcgattctcctgcctcagcctccagagtagctggtactacaggcatgtgtcaccacgcccagctaattccttttttgtatttttagtagagacagggtttcaccatgttgaccaggatggtctgtatctcttgacctcatgatccgcccaccttggcctcccagtgtgctgggattacaggcataagccaccgcgcccagcctacataatattatatatagaaaaccctgcagactgtgccagaaaactattagaattgataaggaagttcaatgaagttcctgatacaaaatcaacttacaaaattcagtagcatttctatacactaaaaacaaactatctgaaaaagaaattaagaaaacaatctcatttacaatagcaaaaagtaatacatgagtaaatttaaccaaggaagttaaatatctgtataccaaaaatgataaaatatttatgaaagaaattaaagatgacataagtggaaagatatcctgtgttcacggagtgaaataattactactgttaaaatctccatactacccaaaatgacttacagattcaatgcaatccttatcaaaattccaagtcattcttcatagaaatagaaaaagaaactaaaatttttatggaaccaaaaatgacacctaacggctaaagcaatctttaccaaaaagaataaagctagaggcatcccactatcaaatttcaaaatacattacaaatctatagtaatcaaagcagcatggtactggcacaaaaacagacacatcaaccaatagaatagaatacagagcccagaaataaactcacacaagtatggtcaattgatttttgacaaaggtgccaagaacacacattggagaaaggacagtcccttcagtaaatggtgttgggaaatctagacatcagaagaatattaaaaatatatttttatatttataatggtgttgggaaatctagatatcagaagaatattaaaaatatataaggaactcaaactacttggtaacaaggaaacaaataaccctattaaaaatgggcaaagtacctgaacagacatttctcaaaagaaagcatacaaatggccaatagatacatgaaaacatgctcaacatctataatcatcagcaaaaattcaagttaaaaccactatgcgatatcacctcacacctgttattttggctattttcaaagagacgaaagataataaatgttggtgaggatgtagagaaaagggaacacttatacattcttggtagtattataaattagtacacctattttggaaaacaatatggagattccttgaaaaattcaaaatagaactaccatatgatccagcaatcccactagtggatatatagccaaaggaaataatactgaagagatgtctgcactcccatgttcattgcagcactatcacaatagccaagatatgaaataaacctgtttccatcaacagatgtaatggatttttaaaatgtggtgtgtgtatacatacacacacacacacacacacgcacacacacacatatagctatatacacacacatgcacacaatgtaatattattcaaccttaacagaaatttttgccatttgcaacaacacagataaacttagaggacattatgctaagtgaaataaaccaggcacagagagacaaatattacattatctgacttatatgtgcaatctaaaaaagtcaaatttatagaagtaaagagtagaatggtagttgccaggggctggagtaggggagtggacagggaaaggggagacattgttcaacaggtacaaagtttcagttacatagaagaaataagttctggtgatctattgcacagcacagtaactatagttgataataatgtattgtatattttgaaatagctacaagggaggattttaaatgttctcaccactaaaaatgctgattattatgaatttatcattctacattgtatacatgcataaaatatgttgtaccccataaatatatataattattatttgtcaattaaaaacagactacctactgaactgtgcactttagttatttttgttatataaatttacttcaattaagaattaaaattaaaaatttttaaatgaaggagaaattttaaaagtgaatcaaataatttggtacccaatatatcctttcatggtgtaaaaatgaaaagtggcccagggaaaagaaattaaggctgcaggtcttccacagatgtctgtaagatttgaggtacctaaaattaagtagagagaaagagaatgtgttttaacaataattgtgggcgtagctgttcgtacatgaatctgaccagagcaaaatagctaaaactttggaataaattgagggagacatactgtcaaaataaaaataagtctggactaatagaaaatatgatggttgtagacttaaaataatcctttggcctctaaccttttatgggtgagaaacaggcccagcagcacctaaaattggaatatttcatatagtaccaaagaggataatagaaaaggaaagattttctgtaggagagttccaagagtcataaataacaataggctgggagagatactctcaaggaacagaacaagagcctaattaaggaatatttcccaccttcagtcattttcagttcacatgtctctgtatcaaaaggagtcccatctggacttgatgacattaccacataacacctagaaatcttagacttttgagctctaaacaatgactgattagtaatttttgacttattgatcctttgacacgggcaattgtattgtgtatgtttaatatttggtgactagaggacagctcacagtaaatgctttcagtctttatcaaatattccagcttttcaacacaaggtgctactttccatagaagaattatacatctcttttttattaaacccaggagtggtcatgtgacctgcctatgaatgaaatgcttaacaaatatttactgtgcacctaagattgctaggtgctttacttctggtgacacaactataaagataaataaagtccttgcattgagaaagcatatgatcttcccaatagagagatgtatgaaaccgagccttcttgccctgctcactaagactcacagcagtatttgtataagaaacacaaacatgttttgaaaaaaggtttgagaagtaaatctttaatgaagtcctacagaagcctaggaatagttgtagtgtgaaggaattatactgaagaagggaaaaggaatttttttaaaaaaatgctgctttggtctacaaataccctttcaactttaggaaatgaaagtaaagaatattacctttttagaaacatatttaggtattgaactatgcttcttagacatgacactgctcacagcctaaagcacatcagctttacaagtgttaaaacacagaaaaatatttcttttaagtccatttagatgtctctcattctaaagctccactcattaccacagctgctgtctcaaatagctctatgctttatcttagaaggtaatcgtgatgaaaatatttaagtttttgttcctgcacagtcaaaataagaatacaaaatgcaaatgtgtgtgtaaaatgggaattttcctgtcacagaactgctattgaggacaataggaccaagtaactctacattaaagagaggtatttgaggccgggcgcagtggctcacgcctgtaatctcagcactttgggaggctgagacgggcggatcacgaggtcaggagatcgagaccatcctggctaacacggtgaaaccccgtctgtacaaaaaatgcaaaaaattagccgggcgtgatggtgggcgcctgtaatcccagctactcaggaggctgaggcacgagaatcgctggaacccgggaggcggagcttgcagtgagccgagatcccgccactgcactccagcctgggcgacagagcgagactccgtctcaaacaaacaataaaaggtatttgaccaaccatctgggaaggacttactaagagctgactccaaaacagttttgtgacttctagcctaccatcatccacctttaggctgtacaaaagaatgtgagagtgcttgaggaaagaggctagtagcacaattttttaaagggtcttctatcaagtgatggggtgtggaatgctgtttcccctctctggttaagttatctccacaactctctcccttttcaaatgaggaaaattttaacctcataaagcatggatgtgtttgccaagaggaaagatttacttctcactcccagccctacaccactcttacaggatctttgctgagaaggaaaaatgtataggcctttcctgtgctattactgaagtaaaacatgtaagaaagttcttgggtgaaatttatctgtatctcctgaagtttgaagggcaccgatattggtaactgacttttcctagtaaattccaaacataagaagccagctggtgctgtttggaataacaaagtacagagatgaagctggtaagaagaagctttcactgtccaagttttggtggaaaaatatggcctattacttcccttgggtgagatcagacatcaaagaaggtagctgggtacatcttgagaggatcctttcctagagatctttctgttgaagtgaggtgaaccccagaaaaaagaggctatgtgggttctactgtaagttcataaagggtaggaaaaagagtgcattgttacaccaaagagcagtgcagtattgaaggtctcaaaagaatgcacaaatgcactccaaatgaaaacagccaacgttttgccatctagagggcatccagtgccatctggaaggcactaattccagattacagtggcactattcaattaaaaccattttgcctccttacttttctcttctactccaatgtatccccaattctcaaaggatctagaagcagtataatgatttggaggatagaaattctcaggaacagtatataaaatggcattgttttgtatatttacataaatagattaaaatatgagtataggacaagatataatgaaaatgaccatgtaaatttgaaaaaccaaagagaattctagaaataaaaatataccaattttaattaaaactcatctgatcagtttgatggcagatcagatacagctgaaattagaaaactaagatagaccaaaagacattacttgaaactcagcacagagacaaaaaataaatacaagagatggagaacatgaaggatagagcataatggtttactatataatcggaggtgtagaaggaggaaagagaaaaaacagagcagagggaatatatggttataaaggcagatatttcccagaactgacagaagaccagtccacagattcagaaatttcaatgaatctcaatcaggatgaataaaaagaaatttacacttagacactgcatttagaaaacaaatttacaagaaaaaaacaaacaaccccatcaaaaagtgggcaaaggacgtgaacagacacttctcaaaagaagacatttatgcagccaaaaaacacatgaaaaaatgctcaccatcattggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaaccatgctgctataaagacacatgcacacgtatgtttattgtggcactattcacaatagcaaagacttggaaccaacctagatgtccaacaatgatagactggattaagaaaatgtggcacatatacaccatggaatactatgcagccataaaaaatgaggagttcatgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtgggggagggagggatagctttaggagaaatacctaatgctaaatgacaagttaatgggtgcagcacaccagcatggcacatgtatacatatgtaactaacctgcacattgtgcatatgtaccctaaaacttaaagtataataataatgaaaaaaaaaagaaatcaagggaatattttacactgctggtgggaatgtaaactagtgcaaccatcatggaaaactatggagattccttaaagaactaaaagtagaactaccatttgatccagcaatccctgggtagattcctacccagaggaaaagaagtaattatacaaaaaagatacttgcacatgcatgtttatagcagcacaattcacaattgcaagagtatggaaccagcccaaatgcccatcaatcaaccagtggataaagaaattgtggtatatataccacggaatactattcagccataaaaagaaatgaaataatggcattcacagaaacctggatggaattggagaccactattctaagtgaagtaactcaggaatggaaaaccaaacatcgtatgttatcactcataagtggaagctaagctatgaggatgcaaaggcataagaatgatacaatggactttggggacttgggggaaagggtgggagaggggtgagggataaaagactacaaattgggtaaaatgtacactgcttgggtaatgggtgcaccaaaatctcacaaattaccactaaagaacttattcatgtaaccaaacatcacttgttcccccaaaacctatgggaataaaaatttaaataaaaaagtaatcaaagacaatcaaagtagcttaataaatggagagaaaggaaagatcttcgttaaaaaggaattccaactgataaatgtagaaggaatgatgaaattggaaaatcactattttgcaaccgaaataggaataaatgattgaggcaagaatcattaatggtgagttaaagtttattgaggagtaagacattcgtatacaattatctcttggtatacatgggtgattggttccaggacctccatgtatacccaaatccatgcatactcaaatccatgcatgctcaagtatcacagtctgcacatatatgaaaagttggccctccataaatgtgagttttgcatcccccaaatactgtatttttgatctggctttgactgaaaacatctatgtataagtggacccatgcagttcaaaccctcattgttcaagggtcaaccgtagtcttagagtgtcttcctacaagacacatgttacttacaaaagaaaaatttgttgctttacagtgggaaaagctggaacacaccaccttaaccaagttatccaaggtaacatcatcagtaatgggacagataaatatcaggctcacctactacaatacactgagtacacaatgttacttctgtgttatttcttccagtagtgcataacatgcacctaatcataagaaaacatcagaaaaacctgaactgagggacattctacaaaatgactggtctgttcttcaaagttgtcgaggtcataaggaaaaggaaagattggggaaccattccagattgaaagagactaaaaaaatcatgaaaactaaatgcaacatacaatcatgtattaaatcctggataagaaaaattatgaggagtcttattgaaacaattgaaaaaaaattgaaaaagatctgcgcattaagtgatagttttatatcagtattaactcccaaatttcaagggttgtactataataatgaatgaaagattgcttgtatttttagacacacactgagctacttaaaggtattgaatatcatatctatgacgtattatcaatgcgttcagaaaaatgctattatatatatattagtaatataaagagagatagatggttatatgatataataataaagcaaatgtggtaaaacaaagtttttaatggggaatgtgggtgaattctttgtattattcttgaaagttttctgtatgtttgaaattatttcaaaatatgaagtttaaaagcattatgggaacctagttttctcaacttcgggaggccaaggcaagcaaatcacttgaggccaggagttcaacaccagcccagccaacatggtgacaccccgtctctactaaaaaacacaaaaagtagttgggtgtgatggtgtgcgcctgtagtcccagctactcgggagactgaggcaggagaatcacttgaacccaggaggcagaggctgcagtgagccaagattgcaccactgcactccagcctgggtgacagagcaagactctatctcaaaaaaaaaaaaaaatagaagaaaaggagaagataccaattctgaatgtggaaagcaatagaatggataaagatataacaggcaaatgcaaactatgaaaatttgatgtaactatattacactgaacacaataaacattagggtaagggaatgtactaaatattaaaaaaaggtcactgcataagaataaaagggtcaacacagcaggatgatatttataaaccttagtcaagtaaaaacgtagcctcaacatttatgaatcaaaaatttacaggaataaaagagaaatgtaaaaactgaacattattaccttcttcagtaactgatagaagaagcaatcataaattcaataaatgtatgaatattggtttaatacaattagtacttttgatctaatggtgacaaacagaatactacacccacctcccagacaaggacttcaaaatagctgtcttgagaaagttcaacgaacttcaagataatgcagagaaggaattcaaaactctactggagaaatttaacaaagagattgaaataattttaacaaatcaagcagaaattctagagctgaaaaattcaactaacaaattttaaaaaatgcaccagggtctctttgcagcagagtcaaacaagcagaagaaaaaaaatagtgagctcaaagacaggctatatgaaaatacatggtcaggggcaaaaaaagaataaaaacaatgaagcctgcctacaagatctagaaaatagcctcaaaatagcaagtctaagaattattgaccttaaacagaatatagagaaatagatgggggtgtaaagtttattcaaagatataataacagagaacttttgaaacctagagaaacatataaatatccaggtataagaaagtcaaagaacaccaggtagactcagcccaaataagactacctcaagttatataataatcaaaatctcaaaggtcaaggaaaaagtaaggatcccaaaggtagcaagaaaaaaagaagcaaataacatataagagagcttcaatacatatctggcagacttctcagcaaaaaccatacaagccaggaggaaataggataacgtattcaaagtgctgaaggaaaaaaaaaaacttctaacctggaatattatatctagcaaaactatcctacaaacatgacgaagaaataaaaatttttctgccaaacaaaagctgaggtattttgactttatatcgtagccattctgactggtgtaagatggaatctcattgtagttttgatttgtatttctctaatcattagtgataatgagcatttttttcatatgcttgtcagccacatgtcagccatatgtcttcttttgagaaatgtctgttcatgttctttgcccatttttaatgaggttatttgttttttacttgatgatttgtttaagttcattatggattctggatataagacctttgtcagatgtacagtttgagaatattttctcccattttgtagtttgtctgtgtattctgttgatagtttcttttgctgtacacaagctctttagtttaattaggtcccacttgtcaatttttgtttttgttgcaaatacttttggggacttagtcataaattgtttgccaaggccaatgttcagaatgatgtttcctagcttttcttctagggtttttgttgttttgggtcttacatttaagtctttaatccatcttgagttgaattttgtatatggtgacaggaaggggtccagtttcaatcttctgtatatggatagcctgttatcctgcaccatttattaaataaggactccttttcccattttcattgttgagtttgtcaaagatcaagttgttgtaggtgtgtgaccttatttctaagttctctatcctgtttcattggtctatgtgtctgtttttgtgccagtaccatgctgttttggttactgtagccttgtagtatagtttcaggtcaggtagtgtgatgcctccagctttgttctttttgcttagggttactttggtgattcatgctcttttttggttgcatatgaattttagaatagttttttcctaattctgtgaaaaatgatgttggccatttgctaggaatagcattgaatctataaatttctttggtcagtatggccattttaacaatattaattatttcaattcataagcatggggtgttttaccattatgtttgtgtcatctctgatttatctcagcagtgttttatagttctccttgtagagatatttcacctcactgtttagatgttgatatggtttgactgtgtctgcatttagatgttcatatggtttgactgtgtctgcacccaaatctcatcttaaattgtagctcccaaaattcctatgtgttatgagagggacccagtgggagataactgaatcatgggggcagtttctcccatactgttctgctggtagtgaataagtctcatgagatctgatggctttataaagaaaaactcctttcacatggttctcattctctctttgcctgctgccatgtaagatgtgactttcaccttccaccatgattgtaaggcctccccagccacatgtaactgtgagtccatgaaacctcttttcctttataagttgcccagtcttggatatgtctttatcagcggagtgaaaatggactactacagtaatttggtactggtagagtggggtgctgctgtaaagatacctgaaaatgtaaaagcaactctggaactgggtaacaggcagaggttggaaaagtttggagggctcagaagaagacaggaaaatgtgggaaagtttggaacttcctagagacttgttgaatggctttcaccaaaatgctgataattacatgaataatgaaatccaggctgaggtggtctcagatggagatgaggaaatttttgggaactggagtaaaggtgactcttgctatattttagcaaacagactggtagcattttgcccctgccctagagatctgcggaactttgaacttgaggtagatgatttaggatatctggtggaagaaatttctaagcagcaaagtattcaagaggcaacttgggtgctgttaaaaactttcagttttataagggaagcagagcataaaagttcagaaaatttgcagcctaacaatgtgatggaaaaataaaaacacacttcctggggagaaattcaagccagctgcagaaatttgcatcagtaatgaaaagccaaatgttaatcacccagacagttgggaaaatgtctccagggcacatttgaggtcttcatggcagcccttctcatcatgggctcagaagcctaggaggaaaaaatgttttcatgggctgggcccagggcccctctgctgtatgcagtctatgaacttggtgtcctgcatcccagctgctctagctgtggctaaaaggggccaagatacagcttaggctgtggctttagaaggtgcaagccccaagccttggcagcttccatgtggtgttgagcctgtgagtgcacagaagtcaataattgaggtttgggaacctccacctatattttagagaatgtatgtaaatgcctggatgtgcaggcacaagtttgctgcaggggtgggacattcatggagaatctctgctacagcagtgtggaaggaaaatgtcaggtgggagctcccacaaagagtccccactggagcactgtctagtagagctgtgagaatatggccaccatcctccagcacccagaatggtagatctaccaacagcttgtaccatgcacctggaaaagccgcagacagtcaacaccagcctgttaaagcagccaggaggggagctatacactgcaaagccacaggggcagaactatccaagtccacgggaacccacctcttgcatcagtgtgacctggatgtgagacatggagtcaaaggagatcattttggagctttaagatttgactgtcccactggattttggacttgcaaggggcctgtagcctcttcattttggccaatttctcccattgggaatagatgtacttacagaattcctgtacacccattgtatctaaaaagtacctaaattgctttgattttacaggctcataggtggaagtgacttgccttgctcagatgagactttggactgtggacttttgagtcaatgctgaaatgagttaagactttagggggactgttgggaaggcatgattggttttgaaatgtgaggacatgggatttgggaggggacggggcagaatgatatgatttggctgtgtcccacccaaatctcatcttgaattgcaggctcccataattcccatgtgttgcgggagggacctggtgggagataattgaatcatgggggtggtttcccccatattgttctcatgatagtgattaagtctcatgagatctgatggctttataaaggaaaacccctttcacttggtgctcattctctttttgcctgctggcatctaagatgtgcctttcaccttccaccatgattgtgaggccttcccagccacatggaactgtgagtccattaaacctcttttcctttataaattactcagtcttgggtatgtctttatcagcagtgtaaaaacggactaatacagatgcattcctccatattttatttttggtgtgactattgtaaatgggattgcattcttaatttggttctgagcttgggtgttattggtgtatagaaatattactgattttgggccgggcgcggtggctcatgcctgtaatcccagcactttgggaggccgaggtgggtggatcacgaggtcaggagattgagaccgtcctggctaacacagtgaaaccccatctctattaaaaatacaaaaaaaaaaaaaattagccaggcatggtggtgggcgcctgcggtcccagctactcgggaggctgaggcaggagaatggcatgaacccgggaggtggagcttgcagtaagccaagattgcgccactgcactccagcctgggtgacagagccagactccatctaaaaaaagtagatgatggaaactacctttgagaaagctcatgtctcttagttttttgatcttttcttttgcttttctagtttctactactaaaaaaatcaaagataacaagggttggcaagaatatagagaaaagtgaacccttgtacatttgtggtgacaatgtaaccaatacagccattatgggcaattgcatggagtttcctcaaaaaattacaaatagaactaccatatgatctaacagtagcaatcccacttctggatataagttctcttatgtttactacttgtacagtgtcatttgtctgtttccaatttttttttaaagtatggtaaaagcatgaaaatagacacatggaccaatgaaaaaaatggaaagcccaaaaataaacccatgcatatatggtcaactaatctttgacaaaatctctaagaacacatattggagaaaagatagtcttttcaataaatggtattggaaacactagatatccacttgcaaaaggtgaagttggatccctattgtattacctacaaaaaatcaattcaaagatctgaaactcctagaagaaaacacggaggaaagctctataacattggtctcagcaattattttttggatttggtgccaaaaacatagacaacaaaggcaaaaataaatgactggtactatattaaactaaaaagtttctgcaaagcaaacaatcaaatgaaaaggccacatatggaatgggagaaaatatttgtaagccacatgtccaataagggggtaatatccaaatatataaggaactcatacaactcaacagcaaataagtaaataaataataataacaaataacctgattaaacaatgggcaaagggcctgaatggatgtgtttccatagaagacctgcaaattgccaataggtatatgaaaagatgctcaatatcactaattatcaggaaaatgcaaatccaaactagaatgacatatcacctcatacctgttagaatggctattatcaaaaagccaaaagataaccaatgttggtgaggatctggagaaaagggaacacttgtacactttggggggaatgtaagttggtacagccactatggaaaacagtatgaagatgcctcaaaaactcaaaaatagaactaccatatatgatccagcaatcccactcctgagtgtatatccaaaggaaataaaaatcaatatttcaaagagatatctgcactgccatgttcatttcattattactcacaatagcctagatatggaaacaacgtaagtgtccatcaactgataaatggataaaaaatgaagtattattcagccataaaaagaaggaagtcctaccattggcaacaacatggatgaacctggaggaaatcatgcgaagtgaaataagccagatataaaaagacaaatactgcatgatctcactgatatgtggaatctaaaatatcaaactcatagaaacagagagacgggtccgttaccaggtggtgggtgtggtggaaatagggagacgttggttaaggggtacaattcataagatgaataatttggagatctaaagtgagacatggtgactatagttaatattgtatacttgaaatttgctaagaaaatagaccttaaatattttcatcattcatgtaaaagtaatgatgaatgttcgttagtttgattgcggtaatcatttcacaatgtatacatagatcaaaacattacattgtataccttaaatatatacaatatttatctgtcaattatacctcaataaagctgtaaaaaaggaaaagtatttatgataataatgcccatcaaacagtgaattccaataaagagatacaattttttgaatcaccaagtagaaaattaggagttaaacagtagaataacaactgaaagatcaatagaaggactcaacaggtttgagcttccagaagaaagagtcactgaacttgaagcagatttgaaaaatactatgtgatctgaagaataaagagaggaaagaatgaagataaattaacagtttctgaaaaatgtggcacaccaataatagcaccaatggacatataatgggcataacagaagatagaagagaaaaattgaggcagaaaaatttattcatataaataatggctgaaatatccccaaactggatttttaaaaccgttaatatatgcatacaaaaagctcaatatattactgaaagacatccccctaagatcaggaacaagacaaagagtctgctccagccacttctattcaacattgtcttgaaagttctgctgtggtaattaggaaagaaaaagaaataaaaagcatccagattggaaaggaagatgtaaaactctctctatgcacagatgacattattttctatatggaaaattctaatgaatacacacacacacacacacacaaactattaaagttactaaatgagctcaacaagattgccgaatacaaggtcaatgtaaaaaaattgattgtatttctataccctagcagtgacaccatgaaaataaaattaagaaaaaattcaattacaatagaataataatataatacttagaaattgatttatcaaaagaggtacaagaacgccaaaaagaagtatagtatactctgaaaactacaaaagatatttttgaaagaaattaaagacctaaacaaatagagagacattccagtcatggattgtaacacttagtattttttagatggcaataatcctcaaattgatctacagatttcatacaatattttcaaaatcctagtttgctttttttgcataaattaaaaagctgatcctaaaattcatgtgtaaatgcaagggaccacatttaaccaaaacaatcttgaaaaagaagaactaagttggaggattcatagtttctgatttcaaaaaatgccacaaagcaacagtaatcaaggcactgcagtactggcataaagataaatgtatagatcaatggaatagaatcaagatttaggaaataagcccacaggtaataaatagtctgacaccattttggtttgactactgacagctcttaagccttactttccctcttccctttctgcctcatatctggggaggctgataggaaagctggggtactgcctcctttaatgctggcaggaagtccaaatcatgtacgggaaccctcacctaggccacacatcctaactgccagaaaaaatggaagttattctccttactctgctctttcaagccatcttcaggcctgctttgaagccactttgatcttcccaagaagactttatcgtgtgtaataaacttttcataccctcttggtgtatgtgtggcgtcattagtctcaacatacaaaccaaattttgagtggggatccatcctgcatattaacatggccacaaaacaccttacatttatgttcaattaatttttgacaagggtgttgaaatcattcaatagagaaggaataatattttcaacaaatcatgcagaaacagttagatattcacacaaaaaataaagctgaaccccctacttcacaacatacacaaaaattaactcagaataggccatagaactaattgtaacaactaaaattataatcctctaaaagttatagtaaatttttgtgaccttggattaggcaatagtttcttagatataacaccaaagtataagcaataacaaaaaattagattaattgaatttcatcaaaatttaaaacttttgtgcatcaaaagacactatcaagaaaataaaaagacaacccacagaatgagataaaatattttcaaatcacatatcgaataagggtcttttccataatttataaagagctcttagaactcaataataaaaagacaatccaattgaaaaaatgggcaaagtatttgaatacacatttctccaaatagacatgaatgaccaataagcacatgaaaagattgtcaacatcattagtcatcagagagattcaaatcaaaccataatgagatactacttcacacccacaaggatggccataagaaaaagaaaatggaaataacaagtgttggtaaggatgtggagaaattacaatcctcatatattgctggtgtgaatgtaaatagtatggccattgtggaaaatagtttgatcattcttcaaaaagttaaagttaaacatagaattactatatgacctatcaattgtactcctaatatatactcaaaagaattgaaatcaagtgttaaaagaaaaaccacacaacttttacagaaattgttcatagcaacaccattcatactaaccaaaaagctgaaacaatatccatcatctgatgaatggataaataaaatgtttgcatacccatacaatggaatattattcagcaatataaagggattaagtattgacacgttatgatagagataaaccttgaaaacatgctaaatgaaagaggttgttcacaaaagaccacacactgtttaattccatttatatgaaatatataaaccaggtaaatccatagagatacaaatagatcagtggttgtcaagggctgtaggtaggggagaatgtcaagtgactgccaatatgtacagcattttgtggggaggtgataaacatgttataaaatgtgattatggtaatgactgcacaaattattgaatttttatttcaaaattggtgaattttatggtacataaattatacctccaaaatatgcaaaaaatgaaatacaagaaaaatttgttggagaaaatttgctatttgagattgagtaaagaatattaatgaagaatgttaaatgaattcccctagattctctgctactataatattaacactataatttaactctataatttaaatatctaaatataatgaaacaactgacatccagagattatgttccattgctggatgagtactcatctgaaagttcttcactgccagaaggtctaggcaacctttccagtagacttagatgataatgtataccattttgaattctaaattccattgaattatctatgtagtcgatagtttttctggaggcattgtccttgcatataaaactagagattaaattcacataattgtgtcagaattgaataaatattttatatgaaagtgttctgcaggaggtcagtttgggcccaagtttttaaagaaggcaaggaatagagagaaaagaatgtattatttaaattaaatagggctatttagctattcaatttccaattattcacctttaagcaatcctattatgctgaaggtcttctgatgcttaccatgtatataatcagattgtgtaaaacactccactgagccatggtctgtttgttgcagcagctttataggcactgaaatgaaaacagtcaagagtagaaaaattatcatgggaactgcagttattcttcacatgtctgagatggtgagaaagctgatatttggcagatatttatttaaagatcaacatattgtgagagcctgaattaaaatagtgttaaaaccaaatttaaaaattacagcattatcacacctatttattacattctgagtattgggtagggtaatggtctaggcattattccagggaagtggaagaaataaactaatgaaattgcaaggctcagaagttaggactgtacactaagtgctagggactcaaaatggaaaatcatgaaaagatttgggattgaagcaatttcaaaataaggatttgacaaataccaaaatgggtctggccattgtttcaattggatgaaatggctccttcctctcagtttagaaaagtattgacatattttaagtcataaaaatccatcaaaacttttctgtgatctcacatcccccagagctatgtctctcttcctctttgtaataaagaatagttcacatttgttttctttgcttgctcaccttctactttctcctcaatccattgcaatctgactctaaattctaccataccactgactaaagtcacaggccgcagttttcagcttactttgccccttaacactactaggtacagttgatcacagatgactgcacaactctgtgcatatactgaaaattattgaatttttattttaaaattggtgttttatggtacaaaaatatacaaaaatgaaatacaataaaaattgttggagaaagtttgccatttgagattgagtaaagaagattaatgaaggttaaatgaattaccctagactctctgctattataatattaactccataatttaaatacctaattgtcttctttctctatgctatcacaccacattcttctcattttcttcctactttacttgtctctcctttgtcccctttgaaagtttctttttctctgcaagtccctcaagtgataatattccttaggattttgtcctattccctcttcttttccaactacacacaacagttatcaccatcttttttttttttttttttttttttttttttgagacggagtctggctctgtcgcccaggctggagtgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcaccgtgtgttagccgggatggtctcaatctcctgacctcatgatccgcccgcttcggcctcccaaagtgctgggattacaggcatgagccaccgcgcccagcccagttatcaccatcttatatcaacctattgtttgtggatttcccccattctatgaatattagtgggataaatataatctactttttagggcaaatgttagcatattttaagatatattaagggtagatttgacatcaaaagcacgggtaacaaaagcaaaaataaacaaatgagactatatccaaaatgcttctgcacagcaaaggaaaaaaatcaacaaaattaagaggcaacctacagaatgggagaaaatatttgtgaactgtgtatctgataaggggctaatatccaaaatatgtaaggaactcacataactcaataacagaaaccccacaaaaaactaataacccaattaaacaatgggcaaaggacttcaaaagacatttttccaaataagatgtaaaatagccaagaggtatatgaaaaatgcacaaaatcagtaatcagaaaaactcaaattaaaaccacaatgagatcacttcacactcattacgatggctattatcaagagacaagtgttggtgaggatgcagagaaaagggagtccttgtacattgctgatgggaatataaattgatacagtctctgtggaaaacagtaaggagtttcctcaaaatattaaaaacagaactaccatatgattcaggaatctcactgctgggtatacatccaaagaaaataaaactagaatctcaaaaagatatctgcattcccatgttccttgcaccatttttcacaatagccaaaataaggaaaccaccttaaagttgacacaagtttatgggtctttgtgacaacatggatgaacctagagggcactaggctaaatgagtaatccaggcacagaaagagaaataccatatgatctcatatgtggaatctagaaaggatgaacttatagaagcagagaatagaatagtgtttgctggggactggagagtgggggaaatggtgagatgccacatatgagatcatatggtatttctctttcagttacaggatgaataagttctgatgatctaatgtacagcatggtagctgcagttaatatttgaaatttggtaagagagcagattataagtgtccttacacacttaaatgcacttaacacacgcacacacaacatggtaactatgatgatgacagacatgttaataaatttgattgtggtaattattgcacaaagtatacatatatcaaatctgtacaccttggatatatacgattttgtttgtcaattatacctcagtaatgctggaaaaaatgtaagggatagctatgttgggttaggtgggacttcaacattttaagtcagtgaagaagggtgtattttgaaattgagacatcacagcttagattattttggatattgccaactgttttggctgcccaaaatattaatccctttctatgaatgcaaaattaccccacctcatgggttttggtgggaagcaaaatatacctcctactacaagggatgaaaattctagatgctaacttgcctaatctccattacagctagggagtggccacataacctaagctccctcaatcagatgtgtctgtgtcagactgagttggaaactaaagatataataagaagatttctctttctggtggcagtggtataatcatttttctaatcagattttcttttttttttttttttttgagacagagtctcactctgtcgccaggctggagtgcagaggtgcgatctcggctcaactgcaacctccgactccctagttcaagcaattctcctgcctcagcctcctgagtagctggcattacaggcacacatcgccacgcccagctaatttttgtatctaatcagagaattctaaggtgtgatttgaggcatttttcttaggtatagctgagccaggttctacattcccttaaacaacttctatgagatctctactgtccttttaataaactccctttctgttcagtcagctaggattggcctctactgcttgcacctaacaaccccaattgatacagctcctaatatttacctctggccctgccctcactctgagatatacgtaagatcatatctcacatatctcacaggttccatacaggatatctcacagtggtttggctctatacctgatatctcacagttatggagccaaaccacttactagctgtgtaatcttgagcacgttacttctttctgaacctttgctcttgtataaaatgagaattatattaatacctacctcacaggaatattgtaatggtcaagtgagaaacttaggtgtcaaaaattgtaaactgaataatgcaatacagtattgtaaaatataatttatactattatagtttattctacattaaatggtagtggtaccttgcttttcttaccaaatgtgtgggaggcttgtaactgtttctttactcctgggaaacaaggtttccccaaagtagctgtatctgcaaacaatgtagagttttatttcttttgacgttgcctctatagtccttgtagagcaccaggagcgaagcactctgttggtaatgatttgaagaaacaaaaataatttgagggttgggaacttgaaagggaggtaaaatagatagcagaacaagaattgatatttctgtaatgcaggcttgagagagacaaaaaagaaactgatgcaaaatactttgaggtctcaaggaaatagaactaaaaagaggatcttacagtaaaaacagtctattcaggctgccatcactgaagcaaatgaatcaggatattgttaacgtttttgtcactttgcttgagatgcatcatggaagaaatatgtactggattggcctgacttggctagcacacctgttctttgcctaggagagggcctggttcctttagaccatatccaaaagagataattctctacaaagaaattgagggtatagggatgacagaaaaatagatgctgacagcaacaacaaatgcacatgattgtgaaatggaaaaagtaatcttgtttttttctaccatgtcatactgccaggctttagtaccatgccaggttgagaattgttttttggtgcagagagactggcatcataatttattttccttagaaagcaatgccacagcacctccaaggttacgggcaaatatcaaataatgatgagtgttgggtttttgtcttctgaaatgagtaaaacaagttctcgtagttttttgtacttgaaaaagtacagtacaatttttatttatgaatgttttaaaaattgccaattttctccaagttcctaatagctcaatttttttactgctctaaatatagagtttacaatgtgttgttttagatttttggtaaccatacatatttagcaattaaagatattagtgctaccaagcgactttgaaaaatactgattactaaaataaaaaagaaatattttgagttttagtgcttaattccttctgttggttatagaagaagtaattgaaatgtagttgaaggagctagattggaggtatctgctatgctctatcactaggacagaatttctcaacctcaggggccatttggggccaaataactcttagttacagggtgttgttctgtgcattgtaggatgtttagagtcatttctggactctacctactagatgcctatagcattccctacccctcagttgtgacagtcacatatatctccagacatagccaacgatttggggagggtgtataaaatcactgctggttcagaactactagactagaggtaaagctacaaaatcctgtgcattgagaaaatcatttatgaagatttcctctttatactgaggttgaggcaaatcaataagggttattcaaaactttgtggcctaagcattcaagagatttgtatcctacagatcatgaatataccagaagcaggaactaatacaatgcaataacaattacagggcagcattgccaaaaatgagaaggatttaggccacagacagaaattacatcactgagaattccatacagacccgtatatgatagctaatgctgaagcacactccagcaataatgctgtgatatagtgttgcattattaactgaaaataagtgagtataactgggttttccaatggaattcttaagaatgttaattttttctgtggaacacactttaggatgagctggactgggaagaagctactgagtttgcacacttgagaaccaagcagtattttctaccacactgtcttgggaaacagcccagaaatacatatcaggtgtagctttcaaaaacaacatttctttggccatgaactagctgagcaagattatattcttactcataatataattttaactagttaagaatgtgtatatcattatacaccaagacaaagctagtctcattacattgcccatatattgaatatcatggtgatctggacaatatcagtctgttatttaaagctcagtaaaccactaacattaaacaaataatttgaaaaactttattgcaggtcttgcatgtctcccatttccaacatacttgtgactggtccatttttattcattacatcacatttctgttttcctctaagaatttgccataacttgcagagaaaattgccaggacagatctatttctgcgctgaagcctcatcatgccattctcacacattttcttgatttggtagttctctaggaaacaaggctgatactttagcttccctttcaaattcaatactatattccaacatgtatatttttaagctgtctggaagcattgaaagtttaaatttccttaaaatgaggataaatctatcatagagtcagttgaacttccagaaatcaattttcagaaggattacaatccaaaaaattacaaaatgagatattacagtgaaagtggctcttacttttgggtagatttcagatctttctctaattataaaatacaaaatactggaggagccaagatggccgaacaggaacagctccggtctacagctcccagcgtgagtgacgcagaagacgggtgatttctgcatttccatttgaggtaccgggttcatctcactagggagtgccagacagtgggcgcaggacagtgggtgcagcgcaccatgcgccagccgaagcagggcgaggcattgcctcactcgggaagcgcaagggatcagggagttccctttcctggtcaaggaaaggggtgacagacggcacttggaaaatcgggccactcccacccaaatactgcgcttttctgacgggcttaaaaaacggcgcaccaggagattatatcccgcacatggctcggagggtcctatgcccacggagtctcgctgattgctagcatagcagtctgagatcaaactgcaaggtggcagcgaggctgggggaggggcgcccgccattgcccaggcttgcttaggtaaacaaagcagccgggaagctcgaactcggtggagcccaccacagctcaaggaggcctgcctccctctgtaggctccacctctaggggcagggcacagacacacaaaaagacagcagtaacctctgcagacttaaatgtccctgtctgacagctttgaagagagcagtggttctcccagaacgcagctggagatctgagaacgggcagactgcctcctcaagtgggtccctgacccctgacccccgagcagcctaactgggaggcatcccccagtaggggcagactgacacctcacacggccgggtactcctctgagacaaaacttccagaggaacgatcagatagcagcattcgcggttcacgaaaatccgctgttctgcagacaccgctgctgatacccaggcaaacagggtctggagtggacctctaacaaactccaacagacctgcagctgagggtcctgtctgttagaaggaaaactaacaaacagaaaggacatccacaccaaaaacgcatctgtacatcaccatcatcaaagaccaaaagtagataaaaccacaaagatggggaaaaaacagagcagaaaaactggaaactctaaaaggcagagcgcctctcctcctccaaaggaacgcagttcctcaccagcaacggaacaaagctggacggagaatgactttgacgagttgagagaagaaggcttcagatgatcaaactactccgagctacaggaggaaattcaaaccaaaggcaaagaaggtaaaaactttgaaaaaaatttagatgaatgtataactagaatacccaatacagagaagtgcttaaaggagctgacggagctgaaagccaaggctcaagaactacatgaagaatgcagaagcctcaggagccgatgcgatcacctggaagaaagggtatcagtgatggaagatgaaatgaatgaaatgaagcgagaagggaagtttagagaaaaaagaataaaaagaaatgaacagagcctccaagaaatatgggactatgtgaaaagaccaaatctacatcgtattggtatacctgaaagtgatgcggagaatggaaccaagttggaaaacactctgcaggatattatccaggagaacttccccaatctagcaaggcaggccaacattcagattcaggaaacacagagaatgtcacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctataagccagaagagagtgggggccaatattcaacattcttaaaggaaagaattttcaacccggaatttcatatccagccaaaccaagcttcatgagtgaaggagaaataaaatcctttacagacaagcaaatgctgagagattttatcaccaccaggcctgtcctaaaagagctcctgaaggaagcactaaacatggtaaggaacaaccgataccagccaccgcaaaatcatgccaaattgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggaaaaagagtcaagacccatcagtgtgctgtattcaggaaacccatctcacgtgcagagacacacaaaggctcaaaataaaaggttggaggaagatctaccaagcaaatgggaaacaaaaaaaggcaggggttgcaatcctagtctctgataaaacagactttaaaccaacaaagatcaaaagagacaaagaaggccattacataatggtaaaggggtcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatatccaggaattgaactcggctctgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattgtaacaaactgtctctcagaccacagtgcaatcaaactagaactcaggattaagaaactcactcaaaaccgctcaactacatggaaactgaacaacctgctcctgaatgactactgggtacataacaaaatgaaggcagaaataaagatgttctttgaaaccaatgagaacaaagacacaacataccagaatctctgggacacattcaaagcagtgtgtagaggggaatttataggactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaattaatgaatccaggaggtggttttttgaaagggtcaacaaaattgatagaccgctagcaagactaataaagaagaaaagagagaagaatcaaatagacgcaataaaaaatgataaaggggatatcaccatcgatcccacagaaatacaaactaccatgagagaatactataaatacctctacacaaataaactagaaaatctagaagaaatggataaattcctcgacacatacaccctcccaagactaaaccaggaagaagttgaatctctgaatagaccaataacgggctctgaaattgtggcaataatcaatagcttaccaaccaaaaagagtccaggaccagatggattcacagccgaattctaccagaggtacaaggaggaattggtaccattccttctgaaactattccaatcaatagaaaaagacggagtcctccctaactcattttatgaggccagcatcatcctgataccaaagccgggcagagacacaaccaaaaaagggaattttagaccagtatccttgatgaacattgatgcaaaaatcctcaataaaatactggcaaactgaatccagcagcacatcaaaaagcttatccaccatgatcaagtgggcttcatccctgggatgcaaggctggttcaatatacacaaataaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactaaatgggcaaaagctggaagcattccctttgaaaactggcacaagacagggatgccctctctcaccactcctattcaacatagtgttggaagttctggccagggaaattaggcaggagaaggaaataaagggtattcgattaggaaaagaggaagtcaaattgtccctgtgtgcagacgacatgattgtagatctagaaaaccccattgtctcagccccaaatgtccttaagctgataagcaacttctgcaaagtctcaggatacaaatcaatgtacaaaaatcacaagcattcttatacaccaataacagacagagagccaaatcatgagtgaactcccattcacaactgcttcaaagagaataaaatagctaggaatccaacttacaagagacgtgaagtacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaacaatgactttcttcacagaattggaaaaaactactttaaagttcatatggaaccaaaaaagagcccacatcaccaagtcaatcctaagccaaaagaacaaacctggaggcatcacgctacctgacttcaaactatactacaaggctacagtaacaaaaacagcatggtactggtaccaaaacagagatatagatcaatggaacagaacacagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaacatcagagtgaacaggcaacctacagatgggagaaaatttttgcaatctactcatctgacaaagggctaatatccagaatctacaaagaactcaaacaaatttacaagaaaaaaaacaaacaaccccatcaaaaagtgggtgaaggatatgaacagacacttctcaaaagaagacatttatgcagccaacagacacatgaaaaaatgctcttcatcactggtcatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatacacccaaaggactataaatcatgctgctatcaagacacatgcacacgtatgtttattgtggcactattcacaatagcaaagacttggaaccaacccaaatgtccaataatgctagactggattaagaaaatgtggcacatatacaccatggaatactatgcagccataaaaaatgatgagttcacgtcctttgtaggggcatggatgaaattggaaatcatcattctcagtaaactatcgcaaggacaaaaaaccaaacaccgcatgttctcactcatagatgggaattgaacaataagaacacatggatacaggaaggggaacatcacactctggggactgttgtggggtgggggaggggggagggatagcattaggagatatacctaatgctaaatgacgagttaatgggtgcagcacaccaacatggcacatgtatacatatgtaactaacctgcacactgtaccctaaaacttaaagtataataataataataaataaataaataaataaataaataataaaaagtaaaaaaaaatacaaaatacctctgtaaccaagaggtattttgtgtctgtgggttatacagcttaaggtattatgcattgatttaaaaattaataaacatgaaaacacagatatagcacttagaaatgagtccaaaactatgcaggactacaatcctttttgataaatcccctcttaattgtaaatacctctgtgaaacttgcctggtctacacttataagacacaagaagctacttatatgtctcaggacatgggtctggtccaaatactcaactattcacagatatcagataccagttttggtcctggcactcatccatgagtttcttatgaagagaagagaagagaagagaagaggagattacgaaataaaaatgtgatgtacaccttaatgtgttatcatttccatcaatgaattttacaacttttcaataaaatgtttctttttactctgatatctagaagttctattcaatgaacactgaaaagatatagacagattcatgatagctagatagatacattagacatgaaaaattaaaaccgtgaattatagctctgtcatttacttgctctatgactattaaaaaattatatccacaaaattttatttctttatgtttcatggagatagtaattcccagcacaagttaagcaaaaaactatgttcaaattcaattactacagaaatcaaagcttttactatatggacaagctgagtactctggctctggaaatgattaggaataacacacaggccaataatatttgtggctcattaaaatgggagagggcacactgaatggcaagaagaaaatcaagagacatggaaccatggaagccaagggaattgagtgtttaaaaaaaggtagactggtaggctgtgtcaaataatcctaaggagttagatcagataaagacatcaaagtgtccatcagatttaacaacatggacatcattaatgacctcagtgaagctggtggtgtcagaaataagactgagtgaatttctattgagaaagtaaagatggagagtgtgtttttttaaacagaataagacaaaataaaggccagtcagaaagctatatatttagtttctattacagactgatctaccagctttccaactggtagatcccttagtccagctcccatctaggtcattaatggcctctgtcacttactagctatggagctatagaagaatcagttcacccacctgattctgtttcctcatccttaaaatggtttaaaaaatagtaactacttcatagagttattatgtagattaatggctagaatgcttatgctgtgccaagcaacatacctggcacatagtagctgtttaataaacatcagctagtattataagaaaggaaagaaattggccaaattaagatcatgtaactaagatcaaaattctcctgatccaaatggtgtaggaaaaccatctaggactaatttctttattttttattttatttaccttgtcctggtagttacatatccaatctgttcctttctcagataaaatcagtgtgttttacttttgaatgtagagttatcgataaccttactctctgagaagttgcatcttacctgtctagttgtgactgacacacagttggcattttcactggtcctaccaattggagttgggcaaaagttttccttggagactttatgaccataaaaagtggaagtgatttctgccttcatttcgttatgtacctagtagtcattcaggagcaggttgttcagtttccatgtagttgagcggttttgagtgagtttcttaatcctgaattctagtttgattgcactgtggtctgagagacagtttgttataatttctgttcttttatatttgctgaggagtgctttacttccaactatgtggtcaattttggaataagtgtgatgtggtgctgagaagaaagtatattctgttgatttggggtggagagttctgtagatgtctattaggtccgcttggtgcagagctgagttcaattcctggatatccttgttaactttctgccttgttgatctgtctaatgttgacagtggggtgttaaagtctcccattattattgtgtgggagtctaagtctctttgtaggtctctaaggacttgttttatgaatctgggtgctcctgtattgggtgcatatatatttaggatagttagctcttcttgttgaattgatccctttaccattatgtaatggccttctttgtctcttttgatctttgttgatttaaagtctgttttatcagagactaggattgcaacccctgcctttcttcatttttctttgaaaccaatgagaacaaagacacaacatacgagaatctctgggacacatttaaagcagtgcatagaaggaaatttatagcactaaatgcccataagagaaagcaggaaagatccaaaattgacaccctaacatcacaattaaaagaaccagagaagcaagagcaaacattcaaaagctagcagaaggcaagaaataactaagatcagagcacaactgaaggagatagagacacaaaaacgcttcaaaaaatcaatgaatccaggagctggtttttcaaaaagatcaacaaaactgagagactgctagcaaaactaataaagaagaaaagagagaagaatcaaatagacgcaataaaaaacgataaaggggatatcaccaccattcccacagaaatacaaactaccatcagagaatactataaatacctctacacaaataaactagaaaatctagaagaaatggataaattcctggatacacataccctcccaagactaaaccaggaagaagttgaatctctgaatagaccaataacaggctctgaaattgaggcaataattaatagcttacaaccaaaaaaagtccaggaccagacggattcacagccaaattctgccagaggtacaaggaggagctggaaccattccttctgaaactattccaatcaatagagaaagagggaatcctccctaactcactttatgaagccagcatcatactgataccaaagcctggcagagacacaacaaaaaaagagaattttagaccaatatccctgaagaacattgatgcaaaaatcctcaataaaatactggcaaaccgaatccagcagcacatcaaaaagcttatccaccatgatcaagtgggcttcatccctcggatgcaaggctggttcaacacacgcaaatcaataaacataatccagcatataaacagaaccaaagacaaaaaccacatgattatctcaatagatgcagaaaaggtctttgacaaaattcaacagccttcatgctaaaaactctcaataaattaggtattgatgggatggatctcaaaataataagagctatctatgacaaacccacaaccaatatcatactgaatgggcaaaaactggaagcattcccttcgaaaactggcacaagacagggatgccctctctcaccactcctattcaacatagtgttggaagttctggccagggcaatcaggcaggaggaagaaataaagggtattcaattaggaaaagaggaagtcaaattgtccctgtttgcagatgacatgattgtatatttagaaaaccccatcatcacagcccaaaatctccttaagctgataagcaacttctgcaaagcctcaggatacaaaatcaatgtgcaaaaatcacaagcattcttatacaccaataacagacagagagccaaatcatgagtgagctcccattcataattgcttcaaagagaataaaatagctaggaatccaacttacaagggatgtgaaggacctcttcaaggagaactacaaaccactgctcaaggaaataaaagaggacacaaacaaatggaagaacattccatgctcatggatagaagaatcaatatcatgaaaatggccatactccccaaggtaatttatagattcaatgccatccccatcaagctaacaatgactttcttcacagaattggaaaaaactactttaaagttcatatggaaccaaaaaagagcccatatcgcgaagttaatcctaagccaaaagaataaacctggaggcatcacgctacctgacttcaaactatactacaaggctacagtaaccaaaacagcatggtactggtaccaaaacagagatatagaccaagggaacagaacacagccctcagaaataataccacacatctataaccatctgatctttgacaaacctgacaaaaacaagaaatgaggaaaggattccctatttaataaatggtgctgggaaaattggctagccatatggagaaagccgaaactggatcccttccttacaccttatacaaaaattaattcaagatggattaaagatttaaatgttagacctaaaaccataaaaaccctagaagaaaacctaggcaataccattcaggacataggcatggcgaaggacttcttgactaaaacaccaaaagcaatggcaacaaaagccaaaattgacaaatgggatctaattcaactaaagagcttctgcacagcaaaagaaactaccatcagagtgaacaggcaacctacagatgggagaaaatttttgcaatctactcatctgacaaagggctaatatccagaatctacaaagaactcaaacaaatttacaagaaaaaaaacaaacaaccccatcaaaaagtgggtgaaggatatgaacagacacttctcaaaagaagacatttatgcagccaacagacacatgaaaaaatgctcatcatcactggtcatcagagaaatgcaaatcaaaatcacaatgagataccgtctcacaccagttagaatggcgatcattaaaaagtcaggaaacaacaggtgctggagagggtgtggagaaataggaacacttttacactgttggtgggactgtaaactagttcaaccattgtggaagtcagtgtggcgattcctcagggatccagaactagaaataccatttgacccagccatccctttactgggtatatacccaaaggattataaatcatgctgctataaagacatatgcacacgtatgttcattgcagcactattcacaatagcaaagacttggaaccaacccaaatgtccaacaacgatagactggattaagaaaatgtgccacatatacaccatggaatactatgcagccataaaaaaggatgagttcatgtcctttgtagggacgtggatgaagctggaaaccatcattctgagcaaactatcacaaggacaaaaaaccaagtaccgtaggttctcactcataggtgggaattgaacaatgagaacacttggacacaggaaggtgaacatcacacactggggcctgtcacgtggcgggggtaggggggagggatagcattaggagatatacgtaatgtaaatgaagagttaatgggtgcagcacaccaacatggcacatgtatacatatgtaacaaacctgcacgttgtgcacatgtaccctagaacttaaagtataataatcataaaaaaaagcggaagggataataatagatgccttttgtgggtacatgattcccagttgctctccatagcattcatgagctatatgtttcttcaggaccttctttagttaggctgggggaatgttggaggtagataatggagaagaatactgtataactcccaaagtactcctagactcttataaaggacctcaaatttcaaccctgctaaatccccatacagtgcctaagtatcttttatagattcccagtaatcagtcatctagaatcttcctaaacacttttaataatagggtatatttgttatgtggctgttgaatagttatattggttaaatgtgtttcctcatgttgaatgaattcctggtctcccttttgcaacttctgcctattaattctacttccatcactaggagttattaaaaaaactaggtctgagtcctctttttcataatactctattagatatttaaggacagtgactttcttgcactacaaaacaaattttctcaacctaagttgagaaacttcctaatttccaaacttctcaccatactttaaaatcgcatatgaaccatgtctagcttgacaataaatttcttaaagtattagaaacaacaccagatagagtctgaatgaaatagagaacaatgtgatttctagaagtcaccttttacttctagtttgaaaacaagcacactatactattattgcctatcttatgagactgtgtcagacactttattgactacccagtatttatttctatctttctttactaataggaggcttaattttgtttgtggtaataatgtactcagccccagttgagacacttgctttttcaggctctttttaagctagagcagccgtgtgacacagatacctaccttttgcatgccatgatatcgcaaaggttactataaatccttatcttttgcttctgcctctcctcttccctccaagtgaatctactaatattcctctttcttcctgaacttctactagcaaaatccattctacccaaatttctcatccaattctgacagaggaagtatataggcagcctactattctaagcttattgcaaggcttatctcgtttaatcctcaaaaataccctatgagctcagtaaaattattatccacatttttcaaaagaaaagcaatgaggatcagaaaggtgaagatactagagagtaagtagtaaagctagtatttaaacatagttcaacatgtttttaacccctgccctgaggtcctcttactaagagtcctttgtcagaggggccaagatggctaattagaagcagctgtggcccgccgcactcagaggaatgaaagaggcaagtgaatacagcaccttcaactgaaatatccaggttcttgcactgggactgattaggacagctcgacccacggagcatgaagataagcagggtggggaaatggctcactcaggagcgacactcagccaagggaacgcccaaacccagccaagggaagcagtgagtgattgtgcaacccctggaaaccacgctcttcccatgtatctttgtaatttgctgatcaggagatccccttgtgagcccaccagggccttggggctgacacacagagttgtctggagtcttggcagagcagatgctcaggcacacaaagagacccagtagcattacatactccagccccgggatccccaacatagatgtctgcaactcatgcagggcaagagagctgcacatacccctaggaagggggtggaacccagggagccaagcagcattgttctgtgggccacactttcatggcacctcacaagataagacccactggcttggaattccagccagctaccagcaacaaggtggagcctgcctaaggctggacagagccccctgtgggcagggggaggggtgggcaccatctctgctctttggtcaactcagctgttccagcctgcaggctttggagaatccaaatggtccagacaggaagggtccctccgttgccatattgtggccaaactgcttctttaagtgggcccaatccattcctcctcactgggcagaacctcccagctgggacttctggccatgcctgcttgcacatattatggacagagctctgaactatctctaggatggagtgccctgaggaggggagggctgccacctgggttggttggacgactcagccgttccagcctgcaagctttggaaagtccaagccaatggggacagaggtggttccccaccatgacacagctgttttgttgaggtgtggccagactgcttctttaagtgggaccccaatccactcctcctcatggggcagatcctcccagcagggtcctccaagccagggcctctggccacccccacccatgttctatagggccaacagagctctaatttctccctgagacagagtgcctgaggggcaaggcaggtcaccacctgagacattcgggcttcttagccagtccagcttctgggccgtggaaagcccaaaccagacgggggctgaaaggatccccaacacagcacagctgctctgccacaaagcagccagactgctcctttaactgggtccctgatcctgttcctcctgactgagtgagaacctccaaatgaggtctctagccacctcctacagacctgttggagccagcaataaatcagtagccctctgggatggagcttccagagaaaggggcagactgccatctttgctgttttgcagtcttcactggtgacacctccaggtgtgggaataactgaggcaagtagggtctggagtgaacccccagcaaatagcagcagccctacagaagactggctagaccattaaaagaaaagcaaacagaaaacaacaacaacaacaaaaaaagtcccccacaaagtccccatccaaaggtcagcaacctcaaagattgaaggtagtaagcccccaaagatgagaaagaatcaatacaaaaatgcagaaaactcaaaaagtcagagtgccccttttcctccaaatgactgcagtgcctctccagcaagggctcagaactggactgaggctgggatggctgaaatgacagaagtaagcttcagaaggtgggtaataatgaactttgctgagctaaaggagcatgttgtaacccaatgcaaagagataagaattaagataaaacaatacaggagctgatagccaaattagtcagcatagagaggaacataactgacctattagaactgaaaaacacactacaagaacttcacaatgcaatcacaagtattaatagcagaatagaccaagcagattattctcagagcttgaagactatttttttctgaaataaggcagggagacaagaatagagaaaaaagaatgaaaaggaataaacaaaacctttgagaaatgggattatgtaaagagaccaaacctttgactgattggggtacctgaaagagatgaggagaatagaaccaagttggaaaacatacttcaggatatcatccaggaaaaattccccaacctagcaagacaggccaacattcaaattcagaaaatgcagagaaccccattaagatacttcatgagaagatcatccccacgacaataatcatcagattcttcaaggttgcaatgcaagaaaaaatgttaagggcagctagagagaaaatccaggtcacctacaaagggaagcccttcagactaacagcagacttctcagtggaaagcccataagccaggagattaggggacaatattcaacattcttaaagaaagaatttccatcccagaatttcctatccagccaaactaagcttcataagcaaagaaataagatcttttttggacaagcaaatgctgagggaatttgttaccaccagatctgccttacaagagctccagaaggaagtactaaatatggaaaggaaagaccattaccagtcactccaaaaccacattgaagtacacagaccagtgacactataaagcaaccatgtaaacaagtctacaaaataactagctaacatcataatgacaggataaaatccacacataacaatactaaccttaaatgtaaatgggctaaatgtcccaattaaatgatacagaatggcaagctggttaaagaaccaagacccactggtatgcggtcttcaagagaaccatctcacatgcaataacacacataggctcaaaataaagggatggaggaaaatttaccaagcaaatggaaaatagaaaaaggcagtggttgcaattctactttctgacaaaacagactttaaaccaacaaaaatcaaaaaagaaaaagaagggcattacataatggtaaaaggttcaattcaacaagaagagctaactatcctaaatatatatgcaccccatataggagcactgagattcataaagcaagttcttagagacattcaaagagacttagactcccacacaataatagtaggagactgtaacatcccactgacaatactagacagatcattgaaacagaaaattaacaaagtattcaggaccttaactcagctctggatcaagtggacttgatagatatttatagaactctccacccaaaaacaacagaaaatacattcttcccatcaccacatgtcacttactctaaaatcgaccacataaagtaaaacactcctcagcaaatgcaaaagaactgaaatcatagcagtctggtatctcccctctcacccatgcttcctctcttgtcatgtgatctcttgcaccaattggctccccttccccttccacaatgaatggaagcagcctcaggccccccgcagaagcagttgttggcaacttgcttcttgtacagcttgcagaaccatgaaccaaagaaacatctttctttgtaaattaccaagcctcaagtattcctttatagtaacactaaatggactaagacaagtaacaataagatggaagagctaaaaaacacaatggactttcaacagggccatactaacaagatataaaacacagcctaaacaagttacaggtgattaaacagtaagtgaacagattactagaacaaaagtcaacattaatagaggaagataatagaatgcagattctctacgatattatacaccatgttcagaaaagaaaatgtgacacaaaaaaagcaatcactaggaatcaaccaaaagatgctccagatgttaaatttaaaagaaaacaatgataaagtagttagtataaatagtttaaataaaaaaggagagatgatatcaggaagacagcaagctaggcggtgctaaccttcatcctctcacaaaaacaacaatttaacaactattcatggatgaaaatagctctgggacagttctgggctacaactaaaaaggaacagtagccgagtggagcacaaaaatcaaggatggctgcatagaaaaaggtaggaaatattttacctctggctggaaaagcttagttccaagaggaatctccttggctatgagttcccactgcagagaataagaagaacaggaggaccccagcaatctttgccattgaggaccccagaagcccttgtgaccatcacggacccctaaacagccttctgctggagaggacccctgcagtctttgcaaatgtaaaactcagttgatggagcctcctggatctcaagttactgtggctcccaaagccagagaaaccaaatccccctcacctggatgatgcaactgtgggcccctcaaagccagtgccactgcgctcccccagccagttgccaaaaagtgcatgtgccccagacctagtgctactgcccacttgacccagatggtgccctcatactcgttcacaggtgaaggcttttccctatagtaaccagtccataaagtctggaagaagtgaccttttttaatgcacagacactgggttgggcagggtcttcaagacggctgattagaggtatctcctactcaccttgtccactaagaagaaccaaaatagcaggtagataactacacctcaagtagatcatccaagagaggacactggaattcaatagtgaaatgacaggaaacaaagcaaggaaagggagggaagtgaggcagcctgcttggccaggattggctgggagctgagacagactccccaatgcatggaaaacgtgagagaccatcagcagtccacattcccattatgaactcctgaaatcctagtttgagagagccccttaaccctccttggccctgagactaacatggtgagctctctggaaatcacaagaaggaactgcaccagagagaggactcactctgggtaccacaagctcccacgtccttggcaacagtgacacagtaccatctttagagcacagtccacaccggactatgtggtgccctgcatccagcaccaaggtagtagccataggcagcaggcagcaatcctttcccctcacctcctgcaaaggggtggccatgtattttaacatgccccaaggacaaattccactgcctgctattgcagtggctgcagactgctgtgagctgatgcattagtgtgtactcacgctgctatgaagaaatacctcagactgggtaatttataaagaaatgagaactaattgactcacagttccacaggcttggggaggcctcaggaaacttacaactagggtagaaggggaggcaaacacatccttcttcacagggtggcagcaaggagaagaatgagagctgagtgaagcagggaagccctttataaaaccatcagatatcaagagaacttactcactataacgagaacaggatgggggaaaccacacccatgattccattatctccccctggtccctcccatgacacatggggattatgggaactacaattcaagatgagatttgggtggctacacagccaaaccatatcactgtacccctggcccctcccaaaattcaagtcttcacatttcaaaatgtaatcatgctttcccaacagtcccccaaagtcttaacttattccagcattaacccaaaagtccaagtccaaagtctcatctgagacaagaatgtcccttctacctgagcctgtaaaatcaaaagcaagttagttacttcctagatacaatggggatacaggcattgggtaaatatatccaatccaaatgggttaaattggccaaaatgaagaggctacagtccccatgaaagcatgaaatccaatggggcagtctgtcttgaagctccaaaatgatctcctttgactccatgtgtcacatccaggtcacactgatgcaagaggtgagctcccacaaccttgagcagctccacccctgtggctttgcagggtacagcccccttcctggctgctttcatggctggcgttgagtatttgcagcttcttcaggcgcatggtgcaagctttcagtggatctaccattctgtggtctggatgatggtagccttcttctcacagctccattaggcagtgccccagtggggactctgtatgggggctcacaccccacatttcccttctgcactgctttagcagaggttctccataagggctctgcccctgcagcagacctctacctgaacaccacaacttgaggctgcatagagcaggaaggccctggacctggcccaggaaaccattttttcctcctaggccactgggcctgtgatgggagagatgatttagggtatctggtgaaagaaatttttaagtggcaaagcattgaagaggaagcagagcataaatatttgaaaaatttgcagcctagtgattcaatagaaaagaaaatcccattttctgcagagaaattctcagcatcccactctaccagtaccaatttactgtattagtccattctcacactgctatgaagaaatacctgagactgggtaatttataaagaaaagaggcttaactgacttactgttctgctggttagggaggcctcaggaaaattacaatcatggtggaaggagaagcaaacacgtccttcttcacatggcagcaggaaggagaagaagaatgacagccaagtgaagggggaagcccattgtaaaaccatcagatctcatgagaacttactatcatgagaacaggatgcgggtaacaggccccatgattcaatgatctccacctggtccctcccgtaatgcatggggtttgtgagaaatacaaatcatgatgagatttgggtggggacacagacaaaccatatcagatgatgtgtaggcaaagccaactacctatggctgctcccagggaaagcaattccaccttcttaagtaacttagtaacagcacagccattgccgccttcacctgagcattctgttgatgacctatggctcacttcacccctacataacacagtcagcatcttcatgaagcatgatgggggtggtgtgaaaccacagctcagccaggctccacctcatgcccaagatccaagcatatcagtcagaggcccagggattgaccagcccagttcaccaccagtagcacctgagcactcctcccagggtctgacatcaggcccactcaacctgctgttaccaccaaagctggtgcccacccccatgcatcaccttccagtctgggcactggcctccccaacccatcacagccactgccaacaccagcatgagcctaacatagctactggatagccctaccatagctactgccatcacccacatcatgcaggctgtccagggccttaaggactgacccacatgctcagcccatcaatgtcattcctggcacctgaacaagccacctggaggcttaagagtcagccttagaggacccattaacactggcaccaatgtgtgccaacctaaaacccagggacagatttgcccatcccaccattgatgacattgggacccaaaaactggcctacctggcatcccagtcaccagcaaaatttcaccccagcctccagtagtagccacaacctaagccactgaggaaatcagttatcactgatgctgtttacagccaagcaagtcatgcaaagactacactactccccatactccaaagttaaagcactctcctatgatagcaatgtttttaattggaaaaagtgactgttacatcagatgtatggatatcagcgtaaggacaaaagaaacattaaaaagaaatatgacacctacaaagggacacaataattctccagcaacagatcccaattaaaaaaagcataaggccaggcacggtggctcatgcctgcaatccaagcactttgggatgccaaggcaggtggatcacttgaggtcaggagttcatgaacagcctggccaacatggcgaaaccacatctctactaaaaataaaaaaaaaatagctgtgtatggtgacacatgcatataatcccaggtactcaggaggctgaggcaggagaatcacttgaacctgggaggcgaaggttgcagtgagctgagtttgcaccactgcactccagcctgggtgacagggtgagactccatctcaaaaaaaaagaaaaaagaaaaaagaaagcatgaaaccccccaaaattcaaaatttcaatactaaaaattcttagtgatatataagagaattccagaaaacaataggaagaaataagaaaaacaattcaggatacaaatgagaaatttaccaaatagatagatataataaaaacaaaccaaacagaaatcctggagtaaagaattcattgtgagaaatacacactggattcaaaagttacaacaatagactgtatcaagcagatgaaaatctcagaacttgatgacaagtttttttgaaataacccagtcagacaagagtatagaaaaaacaataaaaaagaataagcaaatccttcatgacataagggacaccataggtgacaaatctttgaattatcacagttccaatagacaaagagagaatgaaagggtaagaaaacctattaaacaaaataatagatacaaatttcccaagtaaagagatgtaaacatccagatgcaggaagccgagagactgccaaacagatacaatgcaaaaagctcttctccacagtgcactgtagttaaactgtcaaaagtcaaagacaaagagagaattctaaaattagcaagagaaaagcatctagtcacttataaaggaatccccattagactaacagcagatttctcagcagaaaccttataaacaggagagaattggatgatatattcaaagtgcagaaagaaaaaaattgtcagctaaggacattaaacctaacaaagttatcctttataaataaagcagaaataaactattttccagaaaaacaatagctgagagaatttatcaccgctagaatggctctacaaaaaatacttaagggagtcctacacatggaagcaaaagcatgatatctactatcatgaaaacatatgaaagtataaaacccattaatagagcaaacctacaaataaagaagagaatggaataaaatattatcactatagaaaaccaccaaaccacaatgataaacaataagagagaaagaaaggaatgaagaatattaaaaacaaccagaaaacaatgaacaatatgacaagaacaaaacctcacatatccataataaccttaaatgtgaatggattaaattctccacttaaaatgcatagaatggttaaacgaataaaaacatggcccaagtatatgttgcctacaagaaatgcactttgcctgtaaagacatatatagactgaaagtatagggatagaaaaatatatttcacacaaacagaaagtaaaaataagcaggagtagttagaaaaaacagactttaagtcaaaatagtaaaaaaaaaaaacaatattattatatcatgataaagagatcaatccatggagagtatgtaacaattataaatatacatgtacccgatattggagaactcagattcttgaagcaaatattactagatctaaagagaatggctcaatataataatagtgagggatttcaacaccctactcttagacagatcatctaaagcactggatttatttatttatttattttgaggctgggttataagactggcaaatttttgtatttttggtagagacagggttttaccatgttgcccaggctggcactgagctcctgggctcaagtgatccacctgccttggcctcccaaagtgctgggattacaggtgtgagccaccatgcctggctgaaacattggatttaaatcaggctttaaaccaaatggatctaacagacatttacaaaatatgtcatccaatagttgtagaatacacattcttctcaaaagcacatggaacattctatagaataggcaatatgttaggacacaaaacaagtcttaaactttaaaataccgaagtcatatcaagcatcttgtcagatcacagtggaaaaaattagaaatcaatacaaaacagctttggaaaccacacgaatacatggaaattaaacaacatgcttcagaaagaccattgggtcaatgaagaagttaagatgggaattaaaaatcattgaaacaaatgaaaataaaaatacaacataccaaaacctatgggatacagcaaaagcagtgataagagggaagtttacagcaataaatgcctatatcaaaaaagtagaaagatttaaaatattaaatctttaaaattttaaataaacttttaaagttaaaaaaatctaacaatgtaccttaaggaactagaaaagcagcaacaaaccaaatccaaaattagcagaaggaaagaaataataaagatcagagcagaactacacaaaatagaggaaaaaaatacagtgcatcaatggaacaaacagtaagttttttgaaaagataaacaaaattgataaattgcaagcgagactaaccaagaaaagaagggagaacacaaacattaacaaaattagaaatggaaaagaagacattacaagtgatactacaaaaatgcaaggggtcatcagggattattacgaaaactatatactaacaacaagaaaacctagaggaactggataaatttctggaagcatacaacctaacaagattgaatcaggaagaaatagaaaacctagatggaaaaataatgagtagtgagattgaattaataattaaatgtctcccaacaaagaaaagtccaggactggattcactgctaaattctaccaaacatataaagaagaactaatgccaacacttctcaaactattccaaaaagttcaaggtataagaatacttcctgactcatcctatgagaccagcattactctaataacaaaatcagaaaatgacacaataaatttagaaaagtacaggtcaatattcctaatgaacatagacacagaaattctccacaagatactaggaaaccaaatccaacagcacatcaaaaaatgaatacaccatgattaagtataatttataccagggatgcaaggatgtttcaacatatgcaaatcattgaatgtcatgaatcacatcaaaagaataagaaacaaaaagcatatggtcatctcaatagatgcagaaaaagcatttgataaaattcaatatcatttcatgattaaaaactcgacaaactaggcatagaaggaacctttattatttcaaaataataaaggccatatatgacaaacccacagctagaatcatactgaatggggaaaatttgaaagccttccctcaaagaattggaacaagacaaggatgcctatgtttaccactttcattcaacatagtactggaagtcctgggcataagaatcaggcatagcaatcaggcaagagaaagtaataaaaagaatccaaatcagaaaagataaagtcaaattatttgtctttgtagacaacataaacttacatttagaaaaatgaaaatactataccaagaagctcttagaactgataaacaactttagtaaagttgcagggtataaaaacatagaaaaatcaagagcttttatatacaccaataatgaaatatccataaaagacatcaagagagcattcctatttataatggtcacaaaaacaaacaaacaaacaaaacctcagaacaaatataaccaaagaggcaaaagatctctacaatgaaaactacaaagcgttcgtgaaaaaaactgaagaggacacaaacaaatggaaaatcatcacatgttcgtggatcagaggaattaatatcatgaaaatgaccatacttctcaaagcaacctacaaattaaatgcatttcctatcaaaataccaatgtcatttttcacagaattagaaaaaaaatcctaaaatttatattgaacaaagtgtctgactagccaaagcaattctgagcataaaaaaacaaagctggaaaaatcacactacccagtttcaaaatacaaggctatattaaccaaaacagcatggtactagtataaaaatagacatatacctcaaaggaacagaatagaggacccagaaataaatccacagatttacagccaatcaatcattacaaagtcttcaagaattttcattgggaaaagaggataccctcttaaacaaacggtgttggaaaactggataacaataatttttgattattgtgaaactagagccctatctctcactatgtacaaaaactaattcaagatagattaaagacaaacgtaagacctgaaactataaaacgactacaagaaaacctagggaaaactcctcagcaccttggtttaggcaaagatttcatgactaagtcctcaaaagcacaggcaacacaatcaaaaatagacaaatgggactatattcaactaaaaagcttctgcacacaaaagaaagaaatcaatcgggtgaagaaacaacctatggaataagaggaaatatttgcaagctactcatctgacaggggattaatatccagaatatacaaggaactcaatcaactcaacagtaaaaaagacaataatcccatcaagatgtgggcaaagaacatgaatacatatttatcaagaggagacatacaaatggtcaagagctatatgaacaaatgatcaacatcactaatcctcagggaaatgcaaatcaaaaccacaatgagatattatcttaccacagttagaatggctattattaaaaagacaaaaataacaattgttggcaaggatgtagtgaaacgggaactcttttacagtgttgatgggaatgtaagttagtaatcccctatggaaaacagtataatgatttatcaaaaaactaaaaatagaactaccatacaatccaacaatcccactagtgggtatttatctaaaagaaaataaatcaatatatcaaaaagatgcatgcactccaatgtttattgccacactattcacaatagcaaagatatggaatcaacctacatgtccattaatgcacaaatggattaagaggatgtggtctttatatatatgaccataaaaaagaattaaaccatgttatttgcagcaacacggatggaactgaagtacattatgttaagcaaaataagccaggcacagaatgacaaatttcacatgttctcactcatacatgggatctaaacaagtagatcacagaggtagaaagtgaaatgatggataccggagactgggaattgtgtatgggttggtgaaagaaaggttggctaatgggtacaataatacaactagatagaatatgttctaacgtttgatagcagagtagggtgattatagttaacaacaatgcattgtatttttaaaaatagctagaagacttgaaatgtacccatatataaatgataaatattagggtgatggatattctatataccctgtgtattagggttctctagagggaaagaactaataggatagatgtatatataaaggggattttattaaggagtattgactcacacaatcacaaggtgaggtcccacaataggccatctgcaggctgaggagagaggaagccagtctgaatcccaaagcctcaaaagtaaggaagccaacagtgcagccttcagtctgttgttgaaggtccaagagtcccaaagctgaagaacttggagtctaatgtttgagggcaggaagcatttagcatgggagaaaaatgtaggtggggagaccaagccagtctagtcttttcatgctcttctgcctgcttttattctggccacactggcagctcattagattgtgcccacccagattgagggtgagtctgcctttccgagtccaatgattcaaatgttaatctcctttgacaacaccctcatagacacacccaggaacaatactttgcattcttcaatccaatcaagttgacaatattaaccatcacaccctgactttatcattacatattgtacacatgtaataaatttcacatatatcccataaatatgtacaaatacaatgtatcaaaaatttaaataaaaataaaaataaaagtacagattccagtgctaagctacatgaaatgtgaaaaatcagggaaacatgacaccatcaaagcaacacaacaaatttccagtaacccacccaaaataaatgaagacctacgaaatgcctgatgacgaattcaaaataataaatctaaaggagctcagcaagctacaagagaacacagacagactactcaacaacatcaggaaaacaatacatgaacaaaaaagttccaaaaatattagaaattattaaaaaagatccaaacagaagttctggatctgaagaatacagtggcaaaactaaaaaatgcaatagaccacttcaacagcatattcaatcggagagaaataattagccaactcaaaaacacatcttttgaaattatacagtaagaagagaaaaaaatgaaaatgagaaaagcctacaggatttatggaacactatcatgacatacacattatgatattccccagaacagaagtgagagggaaaggagagaaaagcatatttaaagaaataatgactcaaaacttctcaaatctggggaagaaaatagatacctagattcaagaagcccaaataacgtcacataagtggaacataaacaggtctacactaaggcattataattaatttgtcaaaagtcaaagccaaagagataattttgaattagcaagagaaaagtgactcatcacatataaaggaacttcaatgagacttttagtggatttctcagcagaagtcttgtaggccaggagagagtgggatgatacattcaaagtattgaaattaaaaaaaaaaacctgccaacaagataactatacctggaaaaactatcctttaaaaatgaaagagagataaagtctttcccagacaaacaaaaactgaaggagataatcaccattacatatgccttataagaaacacttaagggagttcttcaaattgaaatgaaaacatgctgggcatgcactcatgcctacaatcccagcactttgggagccaaggcaggcatattgcttgagctcaggacttcaagaccagccaaggcaacatggcaaaactctgtctcaacaaaaaaataaaaaattagccaggcattgtgacatgtgcctgtagtaccagctacttgggaggctgaggtaggaggagcacctgagctcaaggaggtcaaggctgaaatgagctgtgatcacaccactgcactccagcctggatgacagagtgagaccctgtctcaaaaagtaataataaaataaaataaaaacatgctaaacagcaacataaaagcacatgaaagcataaatcttcctagtaagtgtaaatatatagacaaatacagaataatggaacattgtaatgatggtgagtaattactattaccctaatataaaagttaaaaaacaaaaatattaagaataactatcaccacaaaaatttgttaatgactgttctatataaaaggaagtacactctgactacaagaacacaatgtgagggaaggacataaaagtataaagtttttgtatgggatcaaagtaaagttgttatcaacttaaagtagatagttataactacaagatattttatgcaagccttgtagtaaccacaaataaaaaacctataatagacgcacaaaagatgaaaagaatcaaagcaaatgactataaaaaaccatcaaataaagaacacatgagaggactagaggaacaaaacaacagcaaaatggagagaaaacaatgagcaacatggcaataatatattgatatggtttggctgtgttcctacacaaatcacatcttgaaatgtagcttctataatccccacgtgttatgggagggacccagtgagaagtaattgaaccatggaggcaagtttttcccatgctgttctcatgacagtgaataagtctcagggatggttttataaagggcagttcccctgcacatgatctcttgcctaccaccatgtaagatgtgcctttgctattccttcacctttgccatgattgtgaggcctccccaggcatgtgaaactgtgagtccattaaacctatttttctgtataaattacgcagtctcaggtatgctgttatagcagtgtaagaatggactaatatagtaaattggtacccgtagagtggggtactgctattaagatacccaaaaatgtggaagcaactttggaactgggtaacaggcagagattggaacactttggatggctcagaaaaagacaggaagatgtgggaaagtttggagctccctagagatttgttgaatagttttgaccaaaaagtccaggctgaggtggtctcagatggagatgaggaacttattgagaacaggagcaaaggtgattcttgctatgctttagcaaagagactggtggcattttacccctgccctagagatctgtggaactttgaacttgagagggatgatttagggtatctggtggaagaaatttctaagcagcaaagtgttcaagatgtgacttgggtgctcttaaaagaattcagttttactgattcacaaagatatgatttgggattaaaacttatgtttaaaagggaagcagagcagaaaagttcagaaaatttgcagccttacaatgggaaagaacagaaaaacccattttctgaggagaaattcaagccagctgcagaaatttgcataagtaatgaagagccaaatgttaattgccaagacaatggggaaaatgtctccagagcatgccagcagtcttcacagcagcccctcccatcacaagctgggagacctaggagaaaaaaactggttttacgggccttgctgctttgtccagtttcaggacttggtgtcctgcgtcccagccatggctaaaaaggaccatcatacagctcaggccattgcttcagagagtgcaagccacaagccttggcagcttccacatggtgttgggcctgctggtgctcagaagtcaagaactgaggtttgggaacctctgcctagatttcagaggatgcatggaaacacctggatatccaggtagaagcctgctgtaggggcagagccctcatagagaacctctgctagggcagtgcaaaagggaaatgtggagtgggagctgtcacacagagtccccactggggcactgcctagtggagctgtgagaagagggccaccatcatccagcccccagaatggcagatccaccaacagcttgcactgtgcacctggaaaagcctcacacactcaactccagaccataaaagcatccaggaggtggtgggggctgtaccctgcaaagccacaggggtggagctgcccaagaccatgggaactcacctcttgcatcagtgtgaactggatgtgagacatggagtcaaagaagatcattttggagctttcagacttgactgccccactggatttcagacttgcatgggccctgtagcccttttgttttggtcaatttctcccatttggaacaggtgtatctatccaatgactgtacccccattgtatctaggaagtaactaacttgcttttgattttacaggctcataggcaaaagggacttgccttgcctcaggtgagactttggactgtggactttttagttaatgctggaatgaattaagactttgagggactgttggggaggcaggattggtttcgaaatgtgaagacgtgcgatttgtgagggaccaggggtggaatgacatggtttggctgtgttcctacctaaatctcatcatgaattgtagctcccataatccccaagtttcctgggagggacccagtgggaggtaattgaatcacaagggtgggtttttcccatgctattctcataatagtgaataagtctcatgaaatccaatggttttataaagggcagtttccctgcaatgctctcttgcctgctgccatgaaagatgtgcctttgctcctccccagccgtgtgaaactgtgagtctgttaaacctctttttctttataaattacccagtctcaggtatttcttcatatcagtataaaaatggacaaatacatatgttttcacttatcaataattattttaaatatatatcaattgaactttccagttcaaaagacataaaatggctgaatgaaaccaagtgttgagccataaatcataaatctcaatacatttccaaggactgaaaacttatatattccctgaccacatgaagttaaattggaaattaaataatacacttttaagaactaagtggatctaagaaatcacattatacatcatacaatattgtgaaatattattataaaaaagcaacacatcaaaatttatagactgcaactaaaacagttcctaaaggaaaatttatagctttaaatgcttacattagtaaaggagaaaggttcaaactcaaacacatttgtaacttccttaagcaactagaaaaacgagagaaaaataaacccaaaggaagtggaaggaaagaaagaataacaaccagagcagaaatcaatgaaatacaaaacagattaaaaacacaagaaattttaaaagtcaatagcgtcattgaaatgaatactctgacaagtcagcaacaaaatgaatcaaaaaaaacaaaaaggagtgaggaaacacaaattctcaatatgcccaggaatgaatgagaggatatatcgacagactctagagatgctggtagtataacaaggaaatattaagatcaacttcagtcaaaaaatgcaaaaaaataaatagacaaatacaagttactaaaagtgactgaagaaatttaaaatggaaattgtcctatagatattaaagaaattaaaatcagaacaaaaaaccttcttttgtgaagaaaacttcagacccatatagtattactggtgaattctatcaaacacataaaaagcaatagacgttggcgtggatgtggtgaaaagggacggtgcatacactgctaggtgggaatgtataacctctatgggaaacagtatggagattccttaaagaactaaaagtagatctaccacgcgatccagcaatcccactactgggtatctgcccaaaggagaagaagtcattatatgaaaaacacaaatgcacacatatgtttatttcagcacaattcacaaatgcaaagatatagaacgaaccgaagcaccaatcaaccaatgagtagatatagaaaatgtggtatgtacacaccgtggagaactactcagccataaagagaaacagaataatgtcatttgcagcaacttggatggagctggaggccattattctaagtgaagtaactcaggaatggaagaccaaattaccctgtgttctcacctgtaagtgggagctaagctatgagaatgcaaagacatacagagtgatataatggactttggagacacacaagggggaagagtgtgagggtgtgggataagaaaactacatattgggtacaatgtacactactcgggtgatgggtgcactaaaatctcagaatttaccactatataattcatccatttaaccaaaaagcacttgtaagccaaaagttattgaaataaaaaaaaattaaacagttattgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggagtacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaagagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgaggcagaaagccttggaaacttaagtgttctcaaacggaacgccatcctgctttgggggaacacggaggctgccttgcagtcacgtgatcgcgcaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggggaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttgggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtcccggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaaggaaactcgtgaccctaattccatgtctgcgcatttctggactgttgtccccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagacggctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccaggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttcttttgttggactctttagtgtcctctatataagaacatgccatctatgcatctatgaatagagatggttttacttgttcctttccgatctggatgccttttatttctttttcttgactaattgccctgactagaactttgagtacaatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccattaatatggtgtattatatacactgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggcgaacctagctggagacatgataattcatgtgctcattcttcaaaaaatattgaagggtagtgccaggtatactgtgttaagcattgagacaacaccaacgagaaatatagatcagatccctgcatgcagtctggcggaacatacagacaaggagccagacaatgacaacactatactgtgataagtgctatgagaggggaagttcaaggtgctggttatagtttggtttgtttgacccctccaaatctcatgtggaaatttgatacccagtgttggaaggtggggtctaatggaaggtgtttgagtcatggggtggatccttcatgaatggcttggtgccagcctcgcagtaatgagtgagttctcacttgattcattcccacaagagctggttgttaaaaaagagtgtagcacctcccccccaccccaccttgattcctctctcatcatgtgatctctgcacttgccggctccccttcaccttatgccatgagtggaagcagcctgagaccctcaccagaaaccaagcagatgccagcaccatgtttcctgtacagcctgcagaatcatgagccaaataaacctcttttctttataaattacccagcctcaggtattcctttatagcaacacagatggactaagaaagtgctgtaggaacacataagaggagtactttacacagacgtttggggttggggaaatgttcctggagaaatggtgtccaatatgaagcttgaagaacgagtacaagttagccaattggaaaagcggggcattggttggcaggggaggggagtggcgatggggaagtgaaaaagctctagcatgactccacagggatagagtgaggtgaccacagactttggagtcattcctggacaaatgggatgaaggaggaggtctgcgtatgggtaggaagatgagttcagtcttgagcgtgtgaaatttgaaatgcctgtgggatatccagatggagatgaaggagatttggcttaggagttcaggagtgaagtcaatactgaaaatacagatttgcgactcatcagggtagttcttgaagccatgaatgtagttgagaccattcagggagagcacatagaatatataaggggaccaaggacaacttcttttaaggggcaagcaaaagaggaacatcattggaagaagactagaggagtgtctccacagataaagttggtgcggggtgggggggcacgctaaaagataatcaagccagaaagagatgagagcaaaggtgcagaaggaagccagaggaactgaagaagaagggacaaactcagaaacacttgctgagttccaaaatgataagcattaaaacctgttcactgagttaagcaatgcaagtgttgctgggggccttggcaagagcaatttcagtggaggggctggaggcagaaactagaccagacttgtactaggagctcgtgagaaattctaagacatatcttcccaatactgggcagcatgataaatgtccacattagagagaattggtgagcaggtcatgctcagccaaggcattttacatgcctagtggaatctcatgcaggaagcttctctaagcgtagaggtaagggtaggtctgatggcaacaatctctcttacttttccttcttctgcgaatgtcttgatttcccctgcattcctgaaggtaatttcactttgtagacagggttctggttcttttgtttcgccacttgagaagtgttatgccacttcctctggcctccatggtttctaatgagaaatatattgccattctaattccttttcccgtataggtaaggtttcctttctctctctctctgcttttgggacttttttcctaggtccttagttttcagaagtttgactgtgatgcttcttggtgtaggtttctttaagattattctgtttggggttcactcagcttcttaaatgtacaggcatgtgtcttttgccgtatttagaatcttccagccattatttatttgaatactttttcagtcccacccccttcctcctttccttctgtcactatgatgacacaaaaggtagctcttttgtcatattcccacagatccccaagtctccactcatttttcccccagtcacttaggctcaggccacatgttctgaccgggggttttattgttagttccatttcaaagcctttgcaatggtatttggttctgttaagcatgatcagcagtcttggagctggcgaggtctatatcccttactcagtgcagttctcaaagtcctttgtatgtcgtacaggatcacatctgtacatacacaccttgtggggtaagcccagaagctcatacacagcttcatgggtttactttcccaagcacttcctccctccctgcaatctccccagcactttctgcttccctcagcttccccttttcaaccttgtagccatgaagctgttgctgtcgctttagtgactcttctctgccacacgcttcctgtgcctttgccttcctctggtgtgattcggcaggaagaccaaagaggggaaaaagaagtcacgggcacccctttgggacctacaatcagagaggaaggttactttccttcagagctttaatcacctgaaggccctggcggctgccactgtcactgtcactgcctctgtcaccaccactgctgccacaggattgcctgtgggctagaacatgaaagtacaaagaaaagaagaaagaaaaactggggattcccttaactatcgctgagggttagtattcccttttccctcttctcaagtcagaaccagagctctctctgttcacaccactgtctacttctaacttgcaggctacgttgagccaaggatactaaaggggggaaaatgtcaaattcactgctgtttcagtggtgcttcaaattgtagtctttccccggtctgcctccttccatttacttttcagagtcctcaaatagctggcccatgcactgtgtccacattttatagctgcattcagtagagtgtgcatgcttcatctcacccaggagcagaaacattctggagatgttacattttacttttacatttaagtggaacaaatttgttcccttgtaagtaattgatgtgtgtgtgtgtgtgtgtgcacgcgcgcgtgtgcacgcgcacgtgcttaggtgtctttaatttaaagaatttaagaaattctttaattttttttgaagtaccataacacaactagaatatatctcaatattgattgttctgcatcaatttttgatggtagagactttgtcgttttgaggagcaggttcaattcttcctttatttctggaaacttttcacatatggcatctgtggatatttttctatcccatttattaggctctttacttaaggcatgtaaattatcttaatgttggatcagcattagcgtgaccatctaaagtccttcctccatgcccttgtttcgatttgtgtgcatgtctcttctgcatcttgctcttcctaatttacttctttgatccaccatgtggttctttgagttctcggtttcttttctgagctcagtaatctccttttttaaaaaaaaaaaaaaatcatattcggttgccaatcatctggtctttgaaactttgttaagttgaaatcatattttaaattttactatggcttagagaactctagggttagttgcatctgttccttgttttatgcattcttccagtctgtgatggttatctgtcttttgtatactatgatggtttctttctttctctttcttcttcctttcttctttcttttttctttcttcttctttctttctctttctatttccttatttcttttcttctttttcttccttccctcctcccctcttctctttttccctcctttcttccttctttcttccttccttcctccctccctctctctctcctctcttccctccttttccctctccctctatccctgtagattgttagcatcattgctaaaccatttatttttatttcaattatggaaaacattgtcagacgttctatttgctctaacattctgagggtgataatttgagggcaggtgggatgttgatttcaatctaccttttcttctaagatcttgctaaatatcatgtatcatgctctagtccatccatgcaagggtgtgtcttactctgagggttttgttttgtttgcccaactcagcacggtgtcttggaaaatggaaagaattgggagccttcctaccgctggtgaaatctaggagtggcagttgagggcttctgttcacaaaggtatttacttttttctgcttattctctcagtccatttctcctcaagttagagagccttacatcccattctcaggatctgactggctcacattgtttttcctcagtattgcttccagggggtggggacagaatgagaagtgtgctaaaccagccatcctccccacaagaatttatacatatatatatatgtactataaatatatagtacatatatatgtacaataatacatatatatgtactatatataatacatatataaatacatatataaacacctatataatatacatgtatatatgaatacctatatatttatatatatgcatatatatgtatgtatatgtatatatgtatgtatatgtatatgtatatatgtatgtatatgtatatacgtatgtatgtatacatatgtgtatatatgtgcatatattatatatgtatatatttatatataaatgtgcatatatttatatatataaatctgtatatatttatatatataaatgcgtatatatacatacgtatacatttgtatgtataaatacgtatatatttgtatatataaatacgtagatataaatacatatatgtatatttatatataaatatgtatatataaatataaatgtatttatacttatataaatacatatatatgtatttataggtatataactacatatatatgtatttatagttatataactacatatatatgtatttttagttatataactacacatatatgtatttatagttacatatatatgtatttatagttatataactacatatatgtatttatagttacatctatatgtatttatagttacatatatatgtatttatagttatataactacatatatgtatttatagttatataactacatatatgtatttatagttatataactacatatatgtatttatagttatataaatacacatatgtatttatagttatataaatacacatatgtatttatagttatatacatatatatgtatttatagtgaaatacatatatatgtatttatagttatgtaaatacatataaatatatatgtatttatagttatataaatatatatacgtatttatagttatataaatgtatataaatatatacttattgttatataaatataaatatatacttatttatagttatataaatatatataaatatatacttatttatagttatataaatatataaatatatacttacttatagttatataaatatataaatttgtacttatttatagttttataaatatataaatatatacttatttatagttacatacatagataaatatatacttatttatagttatatataaatatatacatatttatagttatatataaatatatacgtatttagatttatatataaatatatacgtatttatagttatataaatatatataaatatatacgtatttatagttatataaatatatacgtatttatattatataaatatatataaatatgttcatatttgtagttatataaatatatataaatatatacgtatttatagttatataaatatatataaatttatacgtatttatagttatataaatatatacgtatttatagttatataaatatatacgtatttatagttatataaatatatacgtatttatagttatataaatacatacgtatttatagttatataaatacatatgtatttatagttatataaatatatatgaatatatatgtatttatagttatataaatatatatgaatatatatgtatttatagttatataaatatatatgaatatatatgtatttatagttatataaatatgtatatgtattgatagttatatcaatatatatgtatttatagttatataaatatatataaatatgtatgtatttatggttatataaatatatgtaaatatgtatgtatttatagttatataaatatatataaatatgtatgtatgtatagttatataaatatatataaatatatatgtaaaatatatgtatctatcgttatataaatatatatgtatctatcattatataaatatatatgtatctatcgttatataaatatatatgtatctatcgttatataaatatatatgtatctatcgttatataaatatatatgtatctatagttatataaacatatatgtatctatagttatataaatatatatgtatttatagttatataaatatatatgtgtttatagttatataaacacatgtatatttttgtatttatataaatataaatacatgtatatttatgtatttatataactataaatacatgtgtatttatgtatttatatttatataaatatacatgtatatttatgtatttatatttatataaatatgcatgtatttatatttatataaatacatgtaaatatacatgtatttatataaatagatagacatatatttatataaatacatgtaaatattcatgtatgtatgtttatataaatacatgtaaatatacatgcatgtatatttatataaatacatgtaaatatacatgcatgtatatttatataaatacatgtaaatatacatgcatgtatatttatataaatatatatgtaatatacatgcatgtatatttatataaatatatatgtaatatacatgtatgtatatttatataaatatatatgtaatatacgtgtatgtatatttatataaatatatttgtaacatacatgtatgtatattggtgtaaatatatatgtaacatacgtgtaagtacatttatataaatatatatgtaatatacatgtaagtatatttatataaatatatatgtaatatacatgtatttatatttgtatctatatatgtaatatacatgtatttatataaatacttatataatatacatgtagatatacatacatgtgtaatgcatgtatgtatattcatataaatatatatatatatattcctgggaagccactttcctccctctctccctccttctcctgcttctcctccttagtcttctcttcttctcctccttagtcttctcttcttctcattctgctttttaccattatttatgtattattttttaatttatttagtaggatcggggaagggagattcttttatctttcttcactctgccatcttttacaaataaattgtaatgttactgactccaagttaagataaaagtttgcttgcttgaatgtgattattgctttgcttgagtttgtagattattcactaaaaatagtctcaggaaaacaggaccttcaacagagataaaagaaaacacgccaaccagcagctctgggaaggggctgaccagcctggtaagaataggctgacggtgcctgtggaaggtcacaaaacactgaccaagaaagcagtgattaactgcccacctgagactgaacacgttttagaagaatgttttgatcattatttcctctgctttcccttaaaaaaccctaatccagaggcacaactcagagaggtgatcactgaagtctagttcactgactcctcccggttgctggcttctcaaataaagctaactttcctttcaccaaagctcctctctttgagtttttggccttcaggtgatgaatggcctggaccggagttcagttacaaaatctctggttttgaagggttatttttttattcctgggatatattccggctgacttggagttagttttagataaatgtaagctttctaatggatctgaatccacactaacggatatgaaattatcaaggtctttttatttttaatcgcaaacacttcattttatcaaatcttaatcgtctccaatttcaccgcaaacaatgcaaggaccttgtcttacaagtcagtgctgtccagtatttagttataatttggtcagtcatattgtttttatgcagtctttttttttttttttttggactcatggccatggttactagtttctttgttcaccattcctctgttgcatcttgctttgttcttttcgttcaatttccttttaatggaagaacatctttaagtcgttctttcagtgagggtttgtgagtggtcagccctctcaacctttgttgaagaatatctttactggctgggtgcagtggctcacacctgtaatcccagcattttgggaggccgaggtgggaggatcatttgagctcaggagttcaagaccaggctgggcaacataatgagactttgtctctacaaaataataaataaataaataaatagccgggagtggtggtgctcacctgtagtcccagctactggggaaaaaaaaaaaattagccaggcatggaggtgcacacctgtagtcctagctactagggaggctgaggcaggaggatcccttgagcccatgagatcgaggctgcagtgagccatgatcgcaccactgtaccccaacctgggcgacagagtgagaccttgtctcaacaaataaataaataaatattttaaaatatatcaaaaagactatctttatttcactcattcttgaattgtagtttagttgggtatgacatttccccccattccccgaatgcattagtgatatgattccatttttattgcagttggtgagaagtctgctgtcagtttattatccctttgatagcactgtgtcttttctttctggttgattttaagatctttccccttttctttgttgacctgcgccggttcccctgtgattcagttttattgattcttgctgtggctcatgcttttagaatacgaggaactatgtctgttttcaaatctgaaaatttccagccagtatccttttgattattggtttacccctgctctctttattctctgattctgtcattcctattagagtttttttggacctttgcatcatttttctgtatctcttaaccgtttatacatttgctatctctccttgctgccttctgaataatttccttacttctatcttccagttcactaaagcagatgaatctgcttttaaacccatcctctgatcttttgctgtcactggaaataatgtctttcattttcggaagttctatttggttccttaaagaaagaaaccggcctcttctttttccgtagaatcttgatctttctcatatgtttggattccttattgtttctaagtatcttatacaaacttattttatactctcggttggctctattatctaaagtttttggtagtgtaatcctgctcatcattgtgtttgctgatactcaatcacaggcggtttttttttttcctcaggtgttttataattttgtttgtgagtttagggatttgttcaaacggcttcatctgtgtgacttcaatgaggtttgactgggggtgtatctctggctgttatctttttgatgttaatgtgtaagcttggggttttcaagacctaaataagaggtattaattccaaccctagacctacatgacaatagccttagagttacaaatgaccaggggaagcattttattttctcccaccagaacccatgaagaaacaaactctcttgtcatctcaccatggtggtgggaagacttttttttcctagtccatcctttcactgactgtgtagcccttgtgaggcaccaaggcttttctcctctccctggtggttattgaatccattcccctaccaccctaacataaattcaaatgcccattgatctgctctttaggttcctctttgttttttgacacctgagggtcaacttccaccataagttcatcacatgtgcattaaaaggaatatttattaaattttatcctgccttttaaaaggtgctttgtaacaggagggttttcaggttatctagtgtgcactgtttccagaaatggaaattgctttcccctttaaaactcccagagcactaagaagctcccacaaattctctggaagaggaatgtgatgggggcgggggaagacttttcatgaatatgtagcctcaaagaaagattggtgctttggggtgccagacactcaatgacagcttaagatgagtgaggaagggcctaggggttgaaagagccctaattgctcaaagccacatgtcacaagaaattttgggaagaagagccactttatgaactggttaccttcatggatttttcttccctaggctcagaagtggaaaaatatgaagatccattgctgatgggaatcctgccctaagcaaacggtggtgagacatggctgcttttagtgcatttattatatgtgaccatttaaaagcaggtactgaaggctgcagaaaagtcacgaggtggtactcaaaatatggttatataggtaactgggtgtggctcttccctgaggcacaaagaactgattttttttgtgtgctctttgaaaggaaatgtataaagttggtattatgctttactcagaaagtttttaagagggttgggagtgatgcaatcactttaaaatgatatacaaggttgaacactctgctaagcttcaggtaagagtatccaattgcctcttggacttccctgcctggatgttctgttccacatgcaccccaaactcaaatatatccaagactgaaaacatcttctctccaagctctctcctcttctaatattccctgtgtgaataaggtgtgcccagttgaccaaaccagtaacctgggagtcatcttgacaacttcctctccctcaacccctctctcgcaattaattggacaccaagttcagtggactctaccttcaaaatgcctctcaaatcaatccacgtctctccttggcattgctgtcgggcagcagggcccaggttcccactcctcttggaaatgacagaggtctcgcctcttctgcaccttcccccgagcttgaggatctatcctgtccagaagaaatcctttccctttcatatttctatagaatgctgtctaacactttgaattcccttcaggctctgggtttcagaaatcaacacagaaagaatgccgggctattcatttccctccaggatgaagttagaatcttgagggcagcgaggaaggcaggcatatgcattgttgcaaaccttctcaagtgattcagatgtgcagctccggtcaagagccactgcacaacgtggtgagctatttgaatacagggaccatgcctttcaactttgtattcatcaaaacacaacgcagccaatacctgatatagaatcagtgctcagtaaatgttccagtgaatgagtgaatacaagaactaaagaatgatatggtgcaaagaaatggatgaaagggatcttacgagctacttagtgcaatcccttcatttttttttttttcagttgccgtagcgttgggattgcttgaggctcccggatgttcacaggatgtcatttttggcaaccacagaccactagttacccagcttttttaggtgttgtgtagcaaggagggatttcgggttatgtaatctgcaatatttccagaaatggaaattatttctttttccttttatgactcacacaacgtcaggaaatttccacaaaattcccagaagaacatgatggaggaaaccactttccctatatatattttagtggaatatattttattttaatggaactgccagtgaagcagtagatgtggccagcagacactgctttcctggtgtctcctgagaactcttttctctcattggttattttcacctgccttcttctgcaagttcctttttgtttgggctcattttccattttctctgtatccaggtttgttgaaaatgcaggagccagtgcttcccaaccttccctactccaaacgcctatgcacacgcacccacttgcatgcgtgcacgtacacgtgcatacatatacacccacacgtacatgcgtgtgtgcacacacactcctggactcttgagaagctttcaaaaggaacttatagatagggtgaggacttttactattaattattaattattattattattacttatatctgaaatataacattttggacacacggaagtgctctaacccccaaattcctgtttgtctctggaaaggagcaggcagtctaggatgggcagggacacacaagacaacttatcttttgccatatgcattagacctaaagtatttacaaagcaaaagaggcagctgtggcgagacagaaaaagccctggattcagaattaaaacagctgggttagagtactggctctgtcacttgctctctaactctcagtttcctcatctgtaaaatcggggcaatggtactacttcatattaatacaacctcagctgcaaaagactggtttaggtacccttgttctgagctcccacagactccttgtgcttacctggtgttaacattggctgttaatacatgtgtctcccgtggtacaaggagatcttgagggcagaaattctatttgtctggcctccagcgtgcctgccctcagtgcacagcagaatggtcaatgaatgttggttgagtgaatgaagaacaatcggacatttgcatgtttttgtgtgtataattcctgttgtactatcatcggtagaccgccaggatagtacaaatctatttttattgtatgtaaatttgacatatagacattccaaattaacaggagttgattcgctccccatgttacctaacaactagtttcggaatgttgttggatccctttaggagaatatttcagtacatttgctcccctggttagggttaggggttagggttagggttagggttgtgttcccagcacaagcgtctcctcaataataagccttcacgtgtgtgcaccggcactttaaagagttgttgttgttgttgttttaaaggtgttttctcgtacactgacttatatgctcctcacgagaaccccatgagacaggcaggaaaggtgttcctgctaccacttgatggatgaagaaaccaatgttcagagacattaactgagtcactacacaccacatcaagagcaagtttgtttcagagctgggcctcaaacagaatcgggtttctcatttcacagtctggtgttttttacacaatccatttgttcaacccggctgcaatttgtgatgttgcttcagtgatattttttgcatctcatcctattcctgcttcacaactgcacctcctaccacttgcctcagcatactctcaaccggggcttctcaggtgctcaaccagggcctctccctctaccctgaacatgtcctcttgcaatttcctgcctctggatctttgcatctgttttcacctcttggtgggcacccgttccccacccccacgtcactgcaggttgaaagaaaccctaggcatcctctcggtttcaactcaaagaccacctaacttcatgaaacctctgcagatgggccctgctggatgagatctctctgcccttgaatgcacagagcagtccatgtcttgttctatatccatttccatacctgcttcattcccttctctacagtgtcccttgctccgtgttctcacagccccctgtgctcagttttcacagcacatattgccctatgttgtgagcctgctttcgtcctgtgactgtgagctccttgaggactggaaccttgtctgacttatctcggtatctccagcacgcagcacagtgccggaacacagtagttgctccaaaaaatgttggatgaatgagtggatggatgaatgaacactaccccacacaacgccttggatatagtggctgcaaaataataatggatcaaattgagtctataaccagatctcatttcttttcatcctatctcagtgaaagatgaaggtgctttcttctgactcaggctgtcacttccactcctgctctgggttcgatcccatcctgcctccccaggtgcctcactccatcaattacctcttctctcaagaatgtctaatctctccgtcttctctgcctggctcctttccttgcagtaactaaaatgctcaggtctctcctcctattccaaaaataagtaccctcaattgaatgggtgtcttcttcctcacagtatcaagatatgtacctcatcggggagtaacccagctgagtgagccctttactggggagccttcagtgtgagtctccttagatctttttctcttaggttggtcagatggctcacagaagactcttccagctgccagaagtttaggggcaggggcagggaagaagactgggagttcacagctttcaggacacatgcttccactcaacacccctgttttcagtacaggaccccagccctcaactaagtctgcgaactccccatccagagaccctctgctttaccctctccagggaataacactccaggcttctgtcagagcagggaagggccagcccctcactggcattgacagcaggaggggatttggcaatgaatctacttcttaaaagagttttcaaacagccttcattattttgatacccaccccccttcacttccagaggtaactccacttccagagttaccttggtccagcctttgaagattcctgggggtgaggagtaaatcaagttagctttttgcttttcccactaaggtctcagaattcctagtttgtggccttcttggatctgctaagtcagttgccactcatccatctgttcttcagcatccaaaatttagttgttgcctcctttcctgttcttcaaccctttttatttcatcttcactcctatccttctaatcctttcaaaaatcacatttgtagcagttccagtggggttttgggagatggtgaagttagatgtggaagtatgtgctccaccttaactatgcatcatcacgagcatgggtgtctgcctgcctgtctcattgattctacacaccttcattaccacaccactctccctaaaactctccagactcagcttttctcatctggctctctgacctgttccctgaccattctgttctttcagctctcagccttcggactgccaaaaccccaagccaacttcctatccaggaaccctccggcctagaagttcagatgtcttgccaatatatctgtgcttcacaacttgcctactctctctgacccctaacattttcacatacttttccaattctgcctgtcataaatttgctgcttccccctaagtagaatgttgattcctgtcaaacacacagcctagccctgattcctcctcttctctcaagcagtgatattgtcaacaatgataaacaactactatgtactgagtgtttttttatgtgctgctcacactttatacacatgtatagattcattcttcatcatagatttttcagctagctggcatttattagccccactttgcatatgtaggaacacaggctcaaggaaagaaagcaacttcccacaatttcccaggctagtaaaagtcagagatggaattcaagcccagatcattccaagtttgtgctcttcctgtgacacgacactgcctcagtcaaggcatcagagaggaagttagaaagcagatggtgagagggagtacctgaattggagggagtacctgaattggagggagtggccaccatcagtgggtagaccatggagaaagatggggctaacagagaaaaaccttcactgagttcacagttttacacagcattagcccttgtgatctttagtcgtgcaggggataaattaccgtgcctgcctgcccacacagaaagtaagctagaacaccactactaatctatatgatatacaccaacatggcttaagacgatttattgcaactgtaaaaaaatgcgcgcccccccccttttttttccagaaaggaagcgtggattgcattaatcaagctaaagacttttatacttctttacagtctgacacaaaaacagacagtcataaagataagcccgaatcatcaagaaagtgcacagtagtattttgcaaacccaatttagggaatcagggaagagtaaaatccacatggataaggtttccccttacttcccattcgtgatggtacagtgagttcatgttatggaacgcccactgctccaaacacatggcaatgatggacaaaatataaaaaggtaaactcaaaaaggcatggccaagacaaaacaaacaaaacaaaacaaaaacaaaagataattgtctccatgttgaagtactaggcttgttgctctggaagcaaaccatggtaaccagaagctaagctcctgcaatgtatagcggttccaaagtaccctgagcaagatggaagacaaaagccatactcacagattaaagcccaggactagaatggagctacccacaaacccaccaacccctgactgtaagtctgacaaaaaagaactaccaccaaactctgccagggtctttggttctgatgagctgcaggcttaaggaggtgaggatgcagacatgttctggtctcgtaactaagagttgagctaatccacagctgagctaagtgagtggatttccaatatgcccaagagcaccctggggccagtgatatggatatgttctatcaaagggttttgagcctaacaactgactggtatttttcaagagaaaaaacagtactgaataggttaatttccttccattcttggaagaggcaaaattagaaatgatgaattttttttttttttttttttttgagacatggtcttgctctgttacccaggctggagtgcagtggcgtgatcatagctcacagtagccttgaactgctgggctcaagagatcctcccacctcagcttcccgagtagctgggactgcaggcactcatgactccacccaactaacttttcttttaattctatttttttgtagaaacggggtcttgctttgctgctcaggctggtttcaaactcctgacctcaagcgatcctcctgccttggcctccaaaagtgctgggattacaggcgtgagccacggcacctggctagattttgcttttaagtttgaaatgctttatttagagtttattagccactaactccttttttttttttttttaaacttttaagttcaggggtacaagtgcaggtttgttacataggtaaacttgtgtcataggggatttgttgcatagattatttcatcacccaggtgttaagcttagtacccattagttgtttttcttgatcctctccctcctcacaccctctatcctccaaaaggccccagtgtgtgttgttcccctctatgtgtccatatgttctcatcatttaactctcacttataagtgagaacatgcagtatttggttttctctttctgtgttggtctgctaaggataagggcctccagctccatccatgtccctgcgaaggacattatctcattctttttcacggctgcatagtattccatggtgtatatgtaccacattatctttctccagtctgtcactgttggggatttaggctgattccatgtctttgctattgtgagtagtgctgcaatgagcatacacatgcatgtgtctttgtaacagaatgatttttagtcctttgggtgtagacccagtaatgggattgctgggttgaatggtatttctgtctttaggtctttgaggaatcaccacactgtcttccacagtggctgaacttgtttacaatcccacagacagtgtataagcattcctttttctccacagcctcgccagcatctgttattttttgactttttaataatggccattttggctaatattagttgggatctcattgtggttttgatttgcatttctctaatgatcagtgatgttgacctttttttttcatatgattgttggctgcatgtatgtctcctcttgaaaagtgtctgttcatgtccttttcccacttttttatgggattgtttgttttcctgtaaatttgtttaagttctttatagatgctggatattagacctttgtcagatgcatagtttgcaaatattttctcccattctgtaggttgtctgtttactctgttgatagtttctttcactgtgcacagctctttaattttattagaccccatttgtcaattttttgcttttgttgcaattgcttttggcgtcttcatcatgaaatctttgcccatgcctatgccctgaatggcattgcctaagttgtctttcagagttttcatagttgggggttttacatgtcagtctttaatccatcttgagtcaatctttgtatatagtgtaagcaagggagccggttttcatcttctgcacatggctagccagttatcccagcaccatttattgaaccgggaatcctttccccattgcttgtttttgtcaggtttgtcgaagatcagttagttgtaggtgtgtggtctcatttctcggttctctgttctgttccatttgtctatgtgtctgttcttgtaccagcaccatgctgtttgggttactgtagccttgtagcatagtttgaagtcaggtagcatgatgcctccagctttgtcctttttgcttaggattgccttcggtattcgggctttttttgttttttggttccatatgaattttaaaatagttttttttttctcgttctgtgaagactgtcaatggtagtttaatgggaatagcattgaatctataaattgctttgggcagtatgcccattttaatactgattcttcctatccatgagcttggaatgtttttccatttttttgtgtgtcatctccgatttctttgagcagtggtttgtagttctccttgtagagatctttcacctccctagttagctgtattcctaggtattttattctttttgtagcaattgtgaatgggagttcattgctgatttggctgtcggctttactgttgctggtgtataggaatgctagtgatttttgcacattgattctgtaccctgagactttgctgaagttgtttatcagcttaagaggcctttgggctgagacaacggggttttctagatataggatcatgtcatctgcaagcagggataggttgacttcctcccttccaatttggatgccctttatttctttcacttgcctgattgccctggccagaacttccaatactatgttgaataggagtggtgagagagggcatccttgtcttgtgccggttttcaaggggaatgcttccagctgttgtccattcagtatgatgttggctgtgcgtttgtcacagatggctcttattattttgaggcatggtccttcaatacctagtttattgagagtttttaacatgaagcgatgttgaattttatcaaaagccttttctgcatctattgagataatcatgtggtttttgtctttagttctgtttatgtgatgagtcacatttattgatctgcatatgttgaaccaaccttgcatcccagggaggaagccaacttgatcgtggtggataagctttttgatgtgctgctggattcagtttgccagcattttgttgaggatttttgcattgatgttcatgaaggatactggcctgaagttttcttttgttgttgtatctctgccaggttttggtttcaggatgatgctggcctcatagaatgagttagggaggagtccctccttctcaattttttgaaatagtatcagtaggaatgctaccagttcctctttgtacatctggtagaattcagctgtgaatccatctggtcctgggatttttttggttggtaggctatttattactgcctcaatttccaaactcattactggtctgttcagggattcagtttcttcctggttcagccttggggaggtgtgtgtgtccaggaatttgtccatttcttctagacttcctagtttatgtgcccagaggtgttcacaatattctctggtggttgtttgtatttctgtggggtcagtgataaatattccccttatcatttctgattgtgtttattcaaatcttctctctttccttctttattcgtctagctagcggtctattttattactttttttcaaagaaaaaaaaaacagcttctggattctttcattttttgaagggtttttcatgtctctgtctccttcagttcagctctgatttttgttatttcttgtcttctgctagttttgggatttgtttgctctcgcttctctagttcttttagtagtgatgttaggttattaacttgagatctttctaactttttgatgtgggcatttagtgctataaatttccttcttaacactgcctttgctgtatcccagagattctggtactttgtatctttgttctcattagtttcatagaacttcttgatttctgcctaaatttcattgtttacccaaaagtcattcaggagcaggttattcaatttccatgtaattgcatggttttgagtgaatttcttaatcttgatttcaaatttgattcttctgtggcccaagagactgtttgtcatgatttcagttcttttgcatttgtcgaggagtgttttacttctgattatgtggtcgattttagagtaagtgccttgcggtgatcagaagaatgtatattctgttgttttggggtggagagttctgtagatatccaccaggtccatttgatccagtgctgagttcaggtcctgaatatctttgttaactgtctgtctcaatgatctgtctaatattgtcagtggggtgttaaaaagtctcccactatcattgcctggcagtctaagtctctgtgaaggcctctaagaacttgctttataaatctgggtgctcctgtgttgggtccatatgtatttaggatagttagattttcttgttgaattgaaccatttaccattatgtaatgcccttctttgtgttttttgatctttgttgatttaaagtctgttttgtcagaaactaggattgcaactgctgcttttttatgttttccgtttgcttggtagattttcatccatctttttattttgagcctatgtgtgtcattgcatgtgagatggttctcttgaagacagcataccattggatcttagttccttatccagcttgctactctgtgtcttttaactggggcatttagcccatttacaatttaaggttagtattggtatgtttggatttgatcctttcatcatgatgctagctggttattttgcagacttgcttacatgtttgctctgtagtgtcactggtctgagtacttcagtgtgtttttggagtggctggtaaccatctttcctttctacatttagtgcttccttcaggagctcttgtagggcaggtctggtggtaacaaattcccttaacatttgcttgtctgaaaataatcttatttcttcttcgcttatgaagcttactttggccagatatgaaattctgggttggagtttctttaagaatgttgagtattgacccccaatctcttctggcttgtaggttttccactgagacatccactgttagtctgaagggcttccctttgtaggtgacctggcctttctctctagccgcctttaacattttttctttcgtttcaaccttggagaatctgatgattatgtgtgttggggatgttcctttcgtggagtatcttcctggagttctctggatttcctgaatttgaatgttggcctctctagctaggttagggaatttctcatagatgatatcctgaaatgcgttttccaaattggttccgttttccccatctctttcagggacaccaatcagtcttagattcgctctctttacgtgatcccatatttctcggaggttttgttcattgcttttcattcttttttctctattcttgtctgccagtcttatttcagaaagccagtcttcaagctctgaaattctttcctccgctttgtctattctgctattagtacttgtgattgcattatgaaattcttgtagtgtgttttttcagttccgtcaggttggttacattcttctctacatgggctattttgtctgtcagctcctgcaatgttttatcatgatttttagcttgcttgcattgggttacaatgtactcttttaactcagtgaagttcatttctatccatattctgaattctacttatgtcatttcagccatctcagcctcagcccaattccgaacccttgctagagaggtgatgcagtcatttggaggaaagagggcactctggcttcttgagttttcagcattcttgcactgattctttctcatctttgtgggcttatctaccttcagtctttgaggttgctgacctttggattttttttttcttttaacagtctggccatgtttctgtagggctgctgtactttgctgggcttcttctccagttcctagtctccttggattttccagtacctggagctatcaccagtgaaggctgtgaaacagcaaagatgtcagcctgcctcttcctctgggagctccggcccagcgaggtacagacctgttgccagcccaaatgcgcctgcaggacaaggctggagaccctggttgggaggtctcacccagtcaggaggaacgggatcagggaactgcttaaagaagcagtctgtccatgctttcacagatcagctgtgctgtgctggggcactgcttccacccctggttggtgtgggctctccaaagcctggaggccggaacagctaagtcgcccaaacagcaaagatggtggcccctccctccctccgggagctctgtcccagggagaattcaaatctctgtcagccagagaacaccagtaggggttgctggaggccttggttgaaaagtcccacccagtgaggaggaacagattgggcacctgcttaaagaagcagtctggccatgcttctgaagagcagctgtgctgtgctgttctggggtaccacttctgggagctctgtcccagagagcagcctgcccttccccctgggacctctgtcccaggtaggtgcaacactgctgctggtggctggctggaattccaaaccagtgggtcttatcctgtgaggtgcagtggaagtggggcccgcagatcgtgccgcttggccccctggattcagcctctttcctaggggtatgtacaggggtctaatctcccgctttgcaggagttgcagttacttttgctgggaaacccagggccggagtatgtaaagctgctgggtctctgcacgtgctcaagcggctactctgctgagactccatgtatctctgtgtgtcagactgaaggccctggtggagtgggttcaccaggggatctcctgacccaagggttgcaaggatccatgggaggagcgtggtttcccaggatcgcacattcacttacgacttccctgggtggaggaggttcctctgtctccatgttgctcctgggtgggctgtcatcctgccttgcttttcttcattctctgtggatcgagttgtttccttgattagacccaatgtgggtacctggatgtttcagttgaaggcgctgtatttactcgcccctttccttcccctccatgagaaccactcaccctagctgcttctagtcagccatcttggccactccctccccgccccccaccttttttttttaaatgcttgaaaactatttgcaaaagaaacctagagattctcatggttcttttaagatcttgttggatggactgtgaaagtgggattattgtctatgaatggtcagctagactgtgtgtgtgtggaaagggtgagggaattaacatttattgagcaaaagggcatgctagttaaaatcattgtctctggggacagatttttctgggttttaatccaaactctgacacgtattagccgtgtgacctctatttttcatttgtaaaatggagatgggattgttgcggggattaaaagcacttacaacagtccaggatatagaaagcactgtgtaagagctggctgtcatatattagtcatcagtcatcatacttaataatcacaaaattgttagaaaatcctgtgaggtaggtattttccttaccatacccatatgagaaaacttaagcaaggagaagtcaaacaaagttaccaaagtcacacaattacggagtgacagagcctttagacgctgcctagtccaaggctttcatttcacagaagagaaaactgaagttcaaaataggagagggacatgcctgaagtcatttagtgagccagtgacagaactgggcctagaactcagcagcaggactcttcctgtcagtagttctcaaactttgtcatgtgttacaatcctgcagaggacttgctaaaacaaactgctggtacccatgcctagagtttcttacttagtaggcgtggggtgggccttgaaaatttgcatttctaaggagttctcaaatgatgccactgctggtggtctggggaccctactttgggaaccaccacaacacaccataattcatacatcttttgttcttttcatcatggactacacagtgtgtgacctacaaacactttcaaagaaatgggaaccggtgatgaaaaccaaagaaaattacatatctagcagcaagaaggtacggtgactgaccaacagtcctggtttgtgtgggactctcctacttttaaaatggaaagtcctgtagttctgggcacaagaggatggttggtcactctagatgaaagcaaacaaaagtcagtgtcagctaaatgccaaacgaaaaaggacatacatacagagaatgtggtaacttctggtgaatttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcg

SEQ ID NO: 622 - DNA, 2316 bp, Homo sapiens
aaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggattcctctccatattttgcagcagggtaaatgtaagttttcttacgtagctagatactgtgttccagtgctgttgatgttgtactgttttagcaatgaagagattgatatgggctgattgggggttagggaaagtgaagcagcagaaccagaacagagtggacatttaaagggtgctaataagtaaataattatgtgaagtagcatactggtcgaaatgcataactcaaagataatcgggaagcgtattttcttttcttttcttttttttttttgagatggagtctcgctctgtcgcccaggctggagtgcagtggcacgatcttggttcactgtaagctccgcctcccaggttcacgccattctcctgcctcagcctcccaagtagctgggactacaggcgcctgccaccatgcccagctaatttttttgtatttttagtagagacggggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagc

SEQ ID NO: 623 - DNA, 5622 bp, Homo sapiens
ggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagcta

SEQ ID NO: 624 - DNA, 13533 bp, Homo sapiens
ggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcat

SEQ ID NO: 625 - DNA, 9910 bp, Homo sapiens
aagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcat

SEQ ID NO: 626 - DNA, 3839 bp, Homo sapiens
actataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagcta

SEQ ID NO: 627 - DNA, 241429 bp, Homo sapiens
aagcctgaaagccctacaaacctctgtgcttcataagcctgactgccccacaagccaaggtaccccacaaaccctagttctccagaatcccaactgccaaacaagcccaactgccccacaagccctagtgctccaaaagcctgagtgctccacaagcctgactgccccacaagcccgagtgtcccacaagccaactgctccacaagcccacctaccacacaaggcctagtgcaccagaaacacaactgctccacaagcctgaccaccccaaaagccaaagtattccagaatcccgactgccccacaagaacaagtaccaaacgtgcccgacttctattattctatttatgtgaccttcttgaaagagaaaactgaaatgatggtgtacaaatgagtggatagtagagttagtggtggagaggtgggattaactataatagcaggtggaggggggttttggggggaggaatgtgatgaaattgtttgtattatgatagtcgttttggttccatgaattaacacatgggctaaaacccatagaactggacaccaaaagaaaagaaaataattttagtgttgcaggaagtcagggaccctgaacagaaggaccggctgaagccatggcagaagaacataaattgtgaagatttcatggacatttattagtttcccaaattaatacttttatagtttcttatgcctgcctttactgcagtctctgaacataaattgtgaagatttcatggacacttatcacttccccaatcaatacccttgtgatttcctatgcctgtctttaatctcttaatcccatcatcttcgaaagctgaggaggatgtatgtcacctcaggaccctgtgatgattgcgttaactgcacaaattgtttgtagagcatgtgtgtttgaacaatatgaaatctgggcaccttgaaaaaagaacaagataacagcaatgttcagggaacaagagagataaccttaaactctgactgccagtgagctgggtggaacagagccatatttctcttctttcgaaagcaaatgggagaaatatcgctgaattctttttctcagcaaggaacatccctgagaaagagaatgcgtccctgaggggaggcctctgaaatggccgctttgggagcggctgtcttttatggtcacagctgtgcgatgaaataagccccggtctcccatagcgctcccaggcttattaggacgaggaaattcctgcctaataaattttggtcagactggttgtctgctctcaaaccctgtttcctgataagatgttatcaatgacaatgcctgcccgaaacttcattagcaattttaatttcaccctggtcctgtggtcctgtgatctcgccctgcctccagtgatatcttattaccttgtgaagcatgtgatctctgtgacccacaccctattcgtgcactccctccccttttgaaaatcactaataaaaacttgctggttttgcagcttggggggcatcgtggaacctgccgacatgtgatgtctcccctggacacccagctttaaaatttctctcttttgtactctttccctttatgtctcagaccagccgacacttagggaaaacagaaaagaacctacgtgaaatatcgggagtgaattttgcctgatattttagtatttggtactttacagaataaaatttaaaaagtaagctagagtgactatattacttaattttttactttataagaaggaaaattgccatggataaatagggacattatgcaatgataaaaaatagtcacttaacaggtaagacataataatcctaactgttaattcacctaaaagcagagcttcaaaatacacaaaacatcatctgatagaactgaaaggacaaataatcaaatctacaatcatattttgatactccaacactcctctctgagtaaatgataaatgaactagacagaaagtcctcaaagttatggaaagacctgaacaacaaaatgaaccacctcgagctgattggcttttgctgaatgcgccacagcaaagcagcagaatatacaagattttcaagtatatgtggaagttttaccaaaataaatcataaatcaacccataactaatttaaaataattgaatatgtacaaagtatgtttttaaaatctgtaatgggataaaataaaaaatataacgaatgagatacctgtattttttaaaataacatatttttagtgatccatgtttcaaaaaattcttgaggaaagttagaaaatatttccaaataaattaaaacgtaaatgtcatgtttaaaaatttgtggaattcaggtaaagtagtgcctatatcattaaatgcttgtattagaatgtaagaaaagattcaaacaaaaaatctaaactttgatcttatataatgagaaaagaaaagtaaattaacctaaggccaacaaaaatatatggatgatacccagcactttgggaggccaaggtgggtggatcacgaggtcaggagttagagaccagcctggccaaggtggtgaaaccccgtctctactaaaaatacaaaaattagctgggcgtggtgatgggcacctgtaatcccagctactcgggaggctgaggcaggagaatcagttgaacctaggaggcggaggttgcagtgagccgagatcacaccactgcactccagcctgggtgacagagcaagactccatctcaaaaaaagaaatatatgtatatatattttttatacatatatatatatggatgatatagatagggaaataaaaaatttcagaaattatagaaaaataataaatgaggttgatggaactaaatttactttttaaaaaattttttgagatagaatctcactttgtcgcccaggctggagtgcagtggcacgatctcagcttgctgcaacctctgcctcccgggttcaagcgattctcctgccttagcctcccgagtggctgggattacaggtgcccgccaccgcacccggcaaattttttaatttttagtagagacagggtttcaccatgttggccaggccagtctcgaattccttacctcaggtgatctgcccaccttggcctctaaaagttacttctttaaatagataagactagttgaaatgtctgacatcaatctgagaatttttttctaaaagttgttcagaagcaatgactttgaacaaagcttcaaatagaggaaagtatatgtaaactataattttcttgtgataacactcttcgttctttagagaagattctgagaagacaagattctccttgaaattgtcttaatttttaagtgcctactatgtggcagattttttttttgagacgcggtgtcgcactattgcccaggctggagtgcagtgacgtgatctaggctcaccacaacctccgcctcctgggttcaggtgattctcctgcctcagcttcctgaatagctgggactataggcgtgtgccaccatgcccggctaatttttttgtatttttagtaaagacggggtttcaccacattgtccaggctggtcttgaactcctgacctcgtgatccacccaccttggcctcccaaagtgctgggattacaggtgtgagccaccacgcctggccgtgacagttgttttcaaatgcattagcccatccaatttgaagagcatcctgtaaaggtcagcagaaagagttcaccttcttcactccatagcatttactgcacttccttttgcagtgccatctgtcatctcaggaggccgaagatttcctccttccatctgatgcaggggcagaattttgctcagagtctttgataccttccacataaccattcttgcctgaacacctgtacaggcaccactagtcacactgaaagccagtatgttcctggggagagatgccagacaggaggcagtggaaggctgattaattattcttttcaaattctagctggcatgtcaatcatggaaccatttttcacctcctgggagaagcccagggtttgtaggaattcagactcagttgatcgctgttcctcttagaattcttatgaggggatggaagttttgagcacctaagaaagcctgtccctgtgtttgcccgttcagtccccaggttcagataagaaggtcattaaaataaaactgcaaatatgctagtgactggacaaactctctgtctaccttcaggcctgtaccctaagaaccaggaaattatgtttcaaatcatactctacttgcagcccactgggaaaacaaacagtatgcagaggatttcccagagggaataccaagcgtctaaagttgcagtccagggtggctgtggctgtgagacaagaccaagggtgtgtggtggcagagtcaagggacttttgcaggggataggattactccatgtcccagggaggggaggtgattctgcacagcctccaggggaggcagcagtgaagaccggacagcaggccagttcccctagtcagaagggagggcacatgagggtgactgagaaagggtgctgtgacacgagaaactgtcggggccagaaacaaatcctgggagtgtacttgtcccatgtgcccaggaaggacaggaatgcaagatgtggatgagcacttgaagcctctcccacaacctgatgagcacccatagtaggtgctcaacagaaagcattcagccatgagctcccaggggacttagcacatgccaccccctaatggtgtttgattctcattgtcacctttgtagacctgcttttagtaccttggtctcagggttctttctgtcacctgagagacatggcgcagtgctgagaagatgcagtcaggagatggggctcaggctggggggagggggaacagcataggctctggaggaattcagaccaggggtctttccagccctgtcccttagtagccacgggattctgggaaatacccaagccctgtgaacctcaagctctacgtctgtgaagcaggtgtgacaagtcctttccactaggactgttggagtgtgtgccatgcaagtgaagcacctagctcagggcctggcgtaaattacaagtttaaagaacggcgaatggctgttttttcctatattattttaccccaggccttaacactctgggattttgttgttgttgtcattgttctccaggacttatcagataatatacagcttggtaagacatggaataatcagtcaaagaatgaagtttcatctataaaattcagtaaatatttcctcttagaggacatacttcaaactttggttgttggggagttttcccaagccagatgcagctcacagctcctagaatttgagtcaaggaccaactccttccttctctgcccgctgcttttccatccaaaccactacttttttttcatttcattgccacccaaaatctagccgttgctaaaattagccaaatggcacttgagatgacctaattagaatgtcattttaatagagtcagctttggctcccagccaggcagaagagtacctgtccagtggcttctgggcctcacttccagggatattcacccttatctctcagaaaacacttgcaggtgatgcgtatccatcacctagctcttgtgctgtgttccacctcactggaacaggagcacagaatgctttccattcctgccccagatggaaactcctctctgctttatccactattcaaaaggaactgctgagcagttttctattccaggcttttctctcatgcctgagaatctggctctggcaccacacagcttcattacaattagctccccgagaaggaactacagtttcccaaagtccaaaaggttttggctcagggcatgtacactcaactattaatactctcacctgttgctccacaccctcaccgctctcttattttccctccagatcttagaagacatctagccactttaattatgtgactgcagatcctagactctaccgccctaaggttaggggtggatgtggcttaccttagcatctctactattaacctaagccttccaaatagcagatgctcaatgaatcttttgagaaaaaatgagccagtgagcagggggacctaattattcatatgtaattctcttgcatgatcaaataagccaagcaaatctggtaagacttcaggatagtgggttccctcctggcccaggacaggtctaaaaatgccgtccaaaagccaagttctgaaatcaagaaccccaaaagacagcttggttgtcttctccactgtgggttctaagggccctcactgaaaccagttatgtgaaaccacctggtagttttcctgaaccaaatcttgtggaaaataaacttattaggctgtccgccaggcacaagaattaccctgtgaaaggcatactggaaaacctaccatcagctcccctccatctccagttaggtcagcctcaccagatattctggtactagaacttcagtttggctgggggctctgaaaacagccccttaggcaggcttcccatgagctaaaccaactgaaactgagcagaccaaagaatgagccagatgaggaatctacccattctaaccaaccagcctgtttgtcttactcatccacgtacaaaagaaagtgttagcagctgcacagagtccttcctgttgagctagaaggttgcagttccatgatctagtatcccatcacgggctaaactgaggcagggagtgaggccaagtggatcttgaagtctgactataaaagggatccctagcaaagtttaaacaaacaattgcatcaaggatgtttctaaatttagccactgggtggattaaagaatgtcttgggtcatgtaaagatatgggcttggcatgggatatccaatgttctatggaagctgatcattgtaaaattctaactacatgtcaccctggacccacacaggtctgaactgcatgggtccacttatgcatggattttcttctgcctctgccatccctgagacagcaagaacaagccctccttttcttcctcctcctcagcctattcaatgtgaagttgatgagaatgaagatttttatcattatccacttctacttagtgaacagtaaatatgttttctcctctgtatgactttcttaataaccctttcttacctctagctttctttattgtacaaatatagtacataatacacttaaaacacaaaatatgtgttcatccataatatttccagtcaacagcaggctaatagtagttatgtttctgggggttcaatgtttatacacagatttttgactgcattgggagtcggtccccttaacccccacctcgttcaaaggtctagcatacaggtgttatcttgccaagtgaaagagggaagcataagcaagaaaaaattaagagggataaggatgtcattgtgaaagggagtcttgtttcaacatcttcagagaagctgtctacaggatgaagtcatcgagttctcattctggcttatagcttgaaagtctgcttatggcttcaggcattgtggtgaactctctgagtggctcacacatcaggcgggagggttgtttgttgacgtttacatgagatgttgagctgcagcttacagaggacctgagcagttcccgttagtatgagacttgcagccagataatggagaaaattagaacaatttagaatcatgtatggcctgcaattagactcgaaaacaacgaacagagctacaagctaataacaagtataccatagtttttttaattttcctgaaacttaatttttctctcttctgtctgcatttctatcaaagataactagagtaagactattttgataaaaaaataagtttagtctcatcaaacttagaatgattacttatgtaagtgcagcaaggatccattagccacataggctcttttaaagtttgctttgttggaacttttagggaggattctcagatttcagttttcaaagcctctttatgctaggaagccaaaccaaggtggacttcagactttgtctgctgcacctatagatttgggtgaatttctctcttctcggggtcccccaaatattttgaggttcctgggctttccaggaagtgactttttttctcactataaatctgggaacacttaaagccatacattctatggacgttctcaaacatggtatcgcagtgacaacctgggtagtataactagtattcccagttgcatcctgttataaagagagcagactgtgattgaacttatgcaaacaactttgccataaaatccagaacacccacaaattgtctctgggaggcaagttttacaaaaaccttttttagaaatttgtgcacatgaataggcatccatgtgggggcctatttcagagggcctaatttttaagcacatttttgggatgaacagtattgttcatctgaaatgtttcacatgatggccattgtaagtctaaattatccttatgaagattgcacctttttgaaaaggtttgctgattctgctgcgtaatacttacgcatatagaaagcaggcatagccagaaggtggagtacacagttgtctggaaagcaaggatcccatttttatgttgattcagagataagatcaaagtctaagaaggaaatgccacgggattgggtcctggtttgctttccagtgaaccttgctgcatggatgctgtcttgaggctgacggtgacatggtatttaacttatttgtttcatgaccagctgatcctaacacagacgtcttatttttaggtggcgagtgctctaatcgctcctaagtgcctaaactggagccaccagtcagtcatggctatggctctgagcttcccctgactaacgtagccagtgaatctctcctaccgaagcatacaagcaaaagaaactggagaacccacatccctgcaaatttccaaaagccagagtcacacactgcatgtgataatctgctcctgccatcagttacctttaaaactacatgtattgtcagtgacttgttagctcccacaaacccccaggtcatgttctctctcacaggacaaatgaatcctggaatcaagagccaaaagagtcaggggactcaatgcaaaaatctgacccgagaggaaattagaacacttgtgtctctgtgagggtgagaggggcctccaaagctgtcagtggcatcttccctgcatttgtcaaggagtctccagagacatcagctgtgtcttttgtgtcccttcatgggttgccagaaactgccaagagaataaatgacatcaaatacgatttgaagatcgagctggcttttaaagttttttcacaatactagaattggacaacacaacattctataaaataaaatgagtgttccagtgaaccgagcagaggaggttggcttcataggcagaacagtgctaaagaaagcagaaataagaaaaaaaaatagaaagaaagaaagcagattggtcatttcaaatttactttccacttagggttaaagaagaggagacttccttactatgctgactcaggttaattggaagattctgcacttttttttttttaattggccccttggaaagccctggatgcttacgtggcactcagcacaagtgaccatgttctggttgggtgtggtcagctggggcttaggacaggaggctagttcacagaaatggcctcccctcccctgaaggttgtttcacacaagcccctgaattaatgagtctttctaaaggaggctgtgctagctttcctaaacagaacagtttcccccttttcagttgttcttgaagagtttccatattttgacttacagtacttacctattcttggatattatccactttttccattagggcccacagcgtgttactcatacttgtcttaaattcccagtcagatcattccaacatctctatcatatctgagtctgtttctgatacctgctctttgtcttcacactgtgtgtgtgtgttttttttttttttttttttgtctattagtatgctttgaaatttccttttgcaaacttgccacgatgtgtcagatgaaaagaatggagttaaataggcctttagtgtgaggtttaccttcatctggctgtgtttactgtttgctgtagctgtaggtgtcagaggctaaacctccctgtggtgtccttcacttttcctccttggctgtgtttggttttccttggagacctgctcactatggtctggcactcacagttctttcagtttcattccccagttgatgtggcagtgagctgcagagggaggggaagacttctatcctcctatgactacatggcaggcttgagtcagtgtacaccgggctgtggctttcactagtgcttctcagttttgttttgttttctccttggacagacattaaggggccagaatgttgtagctgggtgttttccttacccagtgttgatgagagtctagaaaaaaaccaagtaggacagactctggtaaaacagtttctcttgagggcagaccctcgtttgaagaacagaatactctgggcatattttcgaatgactcctttctccctctggtcctcactgggggaacctgatagggctcccagaggtgaaactctggaaactgtggtagccttctggatggtgcccccaggagtttttagttctcaaatttgtccatagtgagccctccaccattcgtcttataaagatgaggttttcgtatcctggtccttgtttctgggcattcagctcctgagcttctgctctccaaagttgtggctgactgtatctactgtctcttccgttttgggtcagcaatcagccctatggcctcagctctctgagggatcagagaaaagttgttgttttccaatttgttcagcttcttatcttgtttgcgtcagaggcagagagccatctagctccttacatacccgagtgaacataagcatttaagaaaattggaaaacttttttaaacatagcagttttacataggtatacatgtggcatggtggtttgctgcacccatcaacctgtcatctacattaggtatttctcctaatgctatccctcctctagccccccaccccctgacaggccccagtgtatgatgctcccctccctgtgtccatgtgttctcatggtttaactcccacttatgagtgagaacatgcggtgttcggatttctgttcttgtgttagtttgctgagaatgatggtttccagcttcatccatgtccctacaaaggacgtgaactcatccttttttatggctgcatagtattccatggtgtatatgtgccacattttctttatccagtctatcattgttggacatttgggttggtaccaagtctttgctattgtgaatagtgccgcatggcacgtggatacctatgtaacaaacctgcacgttctgtactatgtaacaaacctgcaggttctgcacatataccccagaacttaaaatgtaataatagtaatttaaaattaaaagagattccctggaaaaaaaatcccatctcaatcactttgctcttttagtatcacttcttgtgtgccctttcctcctttccaaataatcatttgaggcccagctgatacagcatattatcctcaaaggctttgttgactccagctacactgtagattctgtactatacattcttgattttttttaccaaaaaaaaacccaaaaaacaaaaacaaaaacaaaatagccattttaataaaattaaaaatgaaatgctttggtatatatctaacaaaacatgtacatatcaggatggtgaaaactacaaaatgctgatgaaaaattcaaagaaggcccaactaaatagacatagcatgtacattcactggaagactcagtgaagatatgtgatctgtaacaaagcgatccatagatccaatgtaactccagtaaaataccagcaagcttttttgtacttgtacacaagctgattcaaaaagcatacggaaaggtaaaggttttgaaataattaaaacaattttcaaaacacagagtaattgcacaaatcgtaccactcaattttaagatttagcataagcctaaaacaatcaagtcattatggacttttctaagggatacacgtatagattaatggattaaaacagagaatccataaatagatccacgcgaatatagcaatggaggttttagaaaggggtaaagacaatttattggaaaaatattagtcttttcaattagtggtattggaacaactgaacatccatgtgttataaaaaagacttgaccaaaacctcacatgttatacaaaaattaactcaaagtggattacagatccaaatgttacatgaaatactataaaacttttaaagaaggccgggtgcagtggctcacgcctgtaatcccagcactttgggaggccgaggtgggcagatcacgaggtcaggagttcaagaccagcctggccaacatggtgaaaccccatctctagtaaaaatataaaaattagctgggcgtggtggtgcgcacctgcaatcccagctactcgggaggctgaagcaggagaatcgcttgaacccgggaggcggaggttgcagtgagccgagatcctgccattgcactccagcctgggcaatagagtgagactccgtctcaaaaaacaaacaaacaaacaaacaaacaaacaacaacagcaagaaaaaacttaaagaaaacacagggtgaaatattagtagcctgatgtgaggcaaagaggtcttaaacatgacaccagcagtgtgattcataaagaaaagaaacaataaattagacttcctcagagttaaaacttttgctctgagaaagacactgaagagacactaaaaagccaaacgaagtattcacaagtatttgcaaatcatatatacaccaaaggccttttatgaaaattgtataaagattcccaaaatctcaaaacttagaacacatgtcaaaacacaaagtttcaccaaattttgttcaaagatctaactggcttttctttatgattcttgaatgggcattttttctctccgtcaacttgaatgagtgtccctatgtgctgagcaaaagacgttggcttataggcagaagaggacgaaaaaagtagaaacagggaacaaaaggtggtttggtgatttcaaagttgatttccttgtaggattaaagcagagaaaactttcttatcgtgcctgctcaggtacggtgggctccttgttattggttgctgtgactattctgtttttagttttttgagaactggcccgtttcaatgttcactttgatgaatggcaattagtacaagggacactattctgattttgtctgttctgctggggtctggggccagagattagggcaaaacaatggcctcccatgagttcatttaacacaaacaaccacattttttagaagggcaaaacatatcaatagacatttcacccaaaaggacatacgcatgacaaataagcccatgaaaaactattctacatcacagctattagagaaatgcaaattaaaccatgatcagatgccataacacatatttgaaaatgactgaaatttttaacgagatacttgtaagtgctaacaaggatgaagaacaacttgaaatttcatacattgctagtggcagttatgaaacgggacaactgcagaaaatgatttggtaattacttatgaacacatgccatgtgactcagcgatttcatctaagggaaaaagaaaaatttatgttcacacaaaagcctatgtacgtgaatgtttatagcagctccagtcatatttgccaaaacctggaaattatacaaatgtatttccatgggtaaatgggaaatgaaattttggggcatccttacttactatgaaatacttctcagcaatgaaaaagaatgaactactgatacacacaacaatgtgtttcaaactcgaaggtgttttgctgtgtgaaaggagccagtctcaaccagttacatattctattattctgtttacctggcattcttgaaagagaaaactgaaacgatggagtacagatgagtggctgtcagggttcggcgcgcagtggtgggtacagctataaatgaattgcacatggagggggtttcttttggggagaagacgtaataatcttaactattaattcacctaaaagcagagcttcaaaatgcaagaaactacatctgatagaactgcaaggataaatcgccaaatctacaatgatatttggagatggcaacagtcctctccaagtaaatgattgaagtagacagaaattctgcaagggtgtaggaggagctgaacaacaaagaacaaatgtgagctgattagattttagtgagcactcctcagaacgacggtagattatatggtattttcaagtgtgtgtggaatttttaccaaaagagaccagaaaacaacccataaaaaatttaaaataattggaattgtacaaagtatctttttaaaatctataatggaatgtaattcaaaatataacaaaggaaatatctgtaaagtccttaagtatttttaaaataaacaacacatttttactaatccatgtttaaaaaaattcttgaggaaggttagaaaatattttcaaataaataaaaatggaaatgtgatgttttaaaatatctgcaatttagctaaaatgtgcctaggggacattttatgtactgaaatgtttatattagaaagtaataaaagactcaaatatgtatattttgatctcaaatagctagaaaaggaaaaggaaattaaacctaaggtgagcaaaacgatggggataatatagacaagaagagaaaaattaatgaaattgagatttcagaagttttagaaaaacaataaataatactgatggaatcaaaagttagatctttaagtagatcagacaagccgaaaggcccgaagtcaatctgagaaatttaaaacacatgggtttgggccaggtgcagtggttcaagcctgtaatcccagtacttcttgaggcagaagcaggcagatccgttgaggccaggagttcaagaccagcctggccaagatggtgaaaccctgtctctactaaaaatacaaaaattagccaggcgtgcggtgcatgcctctaataccagctattcgggagactgaggtacgaaaatggcttgagcctgggaggcagggattgcagtgagctgtgatcttgccactgcactccagcttgggcaacagagtgagtctctgtctcacaaaacaaagccaaaccccagaaaacgtggttttggagaagcaacagcgttgaacacagctagaagtagaggacactttacagaaactattaactgttgtgacaacaacaatgtttcttagagaagtttctgagaagaccagatttgccttgaaatgctcgacgtgtctgctatgttacagatgctttcaaacgtattaacccaggggtccccaacacccccggccatggataggaactgggctgcacagcaggaagtgagtggttgggcaagcaggtgaagctgaactccacctcctgtcacgtcagtggcgacattagattctcataggagcgggaaccctattgtgaactgcacacgtgaggggtctaggttttgtgttcctgatgagaatctaacgcttgatgatctgttactgtctcccatcacccccagatgggaccatctatttgcaggaaaacaagctcagggctcccactgattctgcacgacggtgagtatgcaataataatagaaataaagtgcgcaataaatgtaatgtgcttgaatcatcttgaaacaatgccccacccccaccccgtgctcatggaaaaattgtcttccagaaaccggtccctggtgccaggaagggtggggatcactgcattaacccatctgatttgaagaggatcctgtaaggtcagcatggagagttcaccttgtacactccatagcattttctgcacttccctttgccacaccatctatcagctcaggaagctgaggatttcctccttccatctgatgcaggggcagaatcttacccatcatctctgctaccctccatatgactgttcttacctgaacacctgtataggtgccactagtcacgctgaaagccggcatgttcctggggacagatgccagacaggaagcagtgaaaggctggttaaatattcttttgaaactccagctggcatgttcgccatggaaccatttttcccctcctgggaggagcccagggtttgtaagaattcagcttcatgaaatggctgctcctcttctacctcttaggaggggaatttctgagcaccatccgtctgtttgcgtgttctgtccccagcttcagataacaaactcaataaaatcctactacaaatatgcaactgactgcgaaaatactctctcaatcctgggggctgcaacccaaccaggagcttatgggtcaaattggactcttctcacagcccactgggaatacacagagtagaattctcccagggagggaggaccaagtgtctaaagtcaccgtccagaatggttgcggctgtgggactggactaagggcgagccgtgcgagaaccaggggactacttcaagggctaggaatgctccatgttgcaggaagggcaggggggtctgcccagcctccagggggaggcaacagtgaagagcaagcagcaggtcaggtcgcagagtcagaagggaggaaacatgatagtgaccggggaagggcactgtgacacgggaacgtgctgatgccagacagaagtgctgattatgtattcgtcccttgtgcccaggaaagagaagatcaaagatgtggatgagcatttgtaggcgctcctacaacctgttgcatagtaggtgctcaacaggcagcacccagcagacagttcccaggggacccccggcatgccatccccaaattgtatttgatgctcattggcaccttctttaggcctgcatttagtaccttggcctcagggtccttctttttgttgcctgagagacatgatgcattgctgagaagaggaatgaagtgccagtgaggaggtctgcctccggctcaggggagtgggaacagcacgggctctagaggaattcagatcagggatccggttccagctctgttccttactagccacctgatcctgggaaatacccaagttctgtgagcctctggttcttcatctgtgaagcaggtatgatgaggcccttccactaggacggttagagtgcgtgcaatgtaagtgaagcatctggctcagggcctggcattaagttagaagtttaaggaatggcggatggctgtcatatctaatactatttgaccctagaccctagcactctgggatttcgtaaatgttgttgttctccaagacttaccagagaatatacagctcagtaggacatgggataatcagccccaacaggaagtttcgtcaataaaattaagtatttcctcttagcgaaggtgcttcaaaatttgggtgtgctggagtcttgcgcagctgaatgcagctcaaagctcctagaatttgaatcgaggatcaactcctttcctctctcccacctgcttttggatccgagactctgttttcacttattttgttaacactcgaaatctagcctttgctcacaattggtcaaatcccacctgagataacttgattagaatgccttttaaatacgatcaactctggctctcccagacaggcagaaaagcacctggccaatgacttctgggcttcccttctgggagattcaccctcatcttgcaggaaacccttgcagatgataggtatccatcacctagcccctgcactgtgttcaagcgcaccgagacaagagcgcgggacgatttccttctattcctgccccaggtggagactcttctctgttcatccactatccaaaaggaactgctgagcagtcgtccattccaggcctttctctcatcctctgagaatctggctctggcaccacccagcttcaatagaattacctcccccagaaggaactgcagtttcccaaagcccaaagggccctggctcagggcatatacactcgactgctgtcatctagagccccaaaccctcacccatgttttattttcctctacttcttagaggacatggcaccaccttaattttaggattgtagcccctagacttcaccaccctatggcaaaggggtgggtctggcttaccgagcatctctactactaacccagggtgttccgaataacagatgttcagtgcgtgtctgaagaaaaaatgagccagtgaacaggaaaaattattctttcaatttttatttctcttacatgctcaaagaagccaagcaaatccaggtatacatgtatatattttaattttacaggagagagaaagaggtataaggcaagaattaactacattttcatttcactatttctttatgagctctattttgctgctaagttcaagtttcaaaaaaattattaattcctctgctatgttatcttgtcccaattcacaaaataacagggatttccccatgtgactcaaaagcaagaatcttactcctaaataacataaacagcaatatgtgtgactactgtcattcattaacttcgatggtgaagttcattaaactgaccattaaaagaacatttgaacaattccaaaagggagcaaggataaatctccaaatcacccaatagacaaggaacccagagatgacatacagtgtgctcacttccacccactgccactgagaacactgattgctctcttcaaacacagagccaagaatgggcctcatgtcacatggggcagggcagctgctggatggggccctgaccccacaaactttggccccggctgcggctggtgctcagactccctcttgctcctctcccaaaacctcttcataaagggatgggtagcagatgggctctcttgcattgagcatgaccaaataatttatgaccttctcatagctggtttcagcgtgggccttggaaccccacaggaactcgtagtgcgcaggatcactgccgggcacctgccggtactccaggtagttttcctgcacccaatcttgggtgagcagcttcctgggctccccgtagaacatgtgctccttcccaacatacacccccatcacactcaacgcttcccagataacctcttcaggggcgcagttgtctttggttaggatcacacccaggacaatgatcaggagggcggccttgggcatgctatgaccatcacccagcatgctatcgcacgagaggccaagagcagtgacaaggatgtaggagtggccggcggggtccacctccttcacatcagtgccaaagatcacctgcatgaactcggaggctttgccgaagatcacaggaaagtagcgcttgtaatttttgatgacgctctccagcatttctgcctttgtgaccggctccttgactcgatatttgtggagcaggaaatgaaccaactcagccaccttcaatttcagtgcttcttggaacatgaactccagctgagctgggtcgaccgaggagcttggctcttcctcttcttgactgctggagccctcatcgaattggctccataaagtgtagtagacggaaatggaggaggaagcgcctccctgaggactctggggaggacttgatgacccagcagcagacacctcctcctccttgctgtcagaggaggaggtagtctcctcctcctcgcctgtgggttcctgtgcacccatcaggcccaagtcctctccttgggcttcaaggtcttcatcaggcttgcagtgcggactcctctgctcgagagacatgatgactctggtcagggcagcagtcaggagcgtgggcaggagctgggcgatggagacccacaggcctggggagagagggagtgtgtgagagacttcagctgagaaccgaaccttggaggttctaacaaaggctgacttacaggtcttcgtcagtgctgctctggggcctcttggggctcctgtcctcctggttagcctgtcccgagaacctgagggaggaagtgagagggctactcagcgtgcagctagcctgcagagatcaaggctctatgagtgacagtagggggaatggggccaggtgctatggggtcccatgtgtgctggggcaggtggggcccttggtgcacattcagggtgaacacttcaccttcactgctgacactgcctgggtctcctctgctctgcgacctgaggacactgtctcagaccaaggcctgcctgcttcctggagctcctggaagaggaatcgaggggcccttaggctgcagactgcaggcagagccccggtccctcagtgctgtcaagagggcgggctggacactcttgagttctacacacttttggggtggatggtcccctctgcgctcactcagggccctgacctttctcctggcagggactggactctactcctctacttgcctgagagtctctcagatcaggagctcacatccctgatatggaacagaaggacatgccccaaccaacatctgcccacacctgcccagggtttcctcggaagtacagtaagagatgtctaaattcaatggggtccatgtgtcctggggtgaggatactgcctggtcctcatcttgatgcctgcagggtctggaaccctccctctgttgacctgaggccctatctccaggagacacctgaagaggaagtgaggggagtccatccacccagcggcttccctcagctgacacaaggggcagggtggggctaggtcctctgtgtttggtgagtggggtcccctcagtctgcacctggactcctggcagggcctgggaccctccctctgctgacgtgagtgcagccccctcagaccaaggccagccctccccgacaccagtgatcccaggataaaggagggacctcagcagacagccctgcccgggctctctggggtgacagtaggggcagggcaaactctcttgatctgagagtttctctggcctggaggtaccctcgatcctcccttaggttcctcacctggactgctctccaatcctgggaccactgtgtctgtcgaacacagggcctccctgttttgtccacacacaccctctgagaacaaagtcctcacctccctgagatccagaaacagaggtgaggaggccccacatatgtcacccctgcgtggggtgtccggggctgaccccaccagctgaacccttcaggtatgaggtgggtgttccaaagtcctcctgcgggttattcatctttactcctgctggggcttctacttcctcgaccctcaaacccttgagatgagcagacatctccctttacaccaacgcctcatccccctgagggttcctcaacttcctgccgtggtacaaatgagcttgccacttagcaccatccttgatcaggcccccccccgcccccagatctaagaacagagttcacctagactctgtggggtggcttctttctgcgttgggggtacctccattcctcatgaagggggcacaccttgggtcctgctgatcctgggagtcctccttctactgaccaggtgtggagccctctgttggatctctcagtgccccctgggatcaaggtactcacctccctgagacctctcacccccagtcacgtgggagaaatgagagcatgcctcatgccattcctgcctggggccacctggggctgagaacaggtgacaccagtgtctgtgaggtcctttcttttttgagagcgtggaggtaccttcttaccttcagtcctcaccaaacttcctccccgtcactcctggaagaccctggattccaccctgtgctgaccaggtgtggctccctctgctgagctgaggaaacccctcggaccaaggcccccacctcccggagacccgggaggcagaagtgaggggccacctcatggtcactcatgcatgagatacccaaggctgaccaaaggagcaggttccagggggcctcgtcggtctgggtgtcctctaggtattcatatttgcttctgacagaatctggccccttccattttgctgaaccagaggtgagtcttgcagaccaaggccaatttctcccttagaccctctttgagaaagtgtgtgttgggggtggagggggcacttcccttcctcaccgtcctgcctggggccttccaagactgacggcaggggcaggtttcctaggtctgggatgagaggtctggtgaatccttcctcaggcctctgggactcctccttctgctcacctgaggccccactcctcataccacagccctgttcccattgacacccgatcccaccagccacaatgcaccacatgcggccaccgtgcccgggatcgcccaggccaagatccccactgagctggactccggggtcccctctgtcctccgtcttgttccttccctggtctcctagagggctgggccccacccctctgtggacctgagtctctatctgtcggattcccgaggctgaatgaggaggggcctcggtctcagataggggcggggtgggccccttgtcctggggtactgggtcccctcaggcctcccttgtctcccagcaggacctgggccctccctctgttctcccgcggccacgctaacgataccaagccccttccctcggtcagcccaggatgcagatatcacgatccgcttgcctgaccgccatgcccggaacttcccagggtccactgcaggggcagtgactccctctatggggcctcagccctccctcagggtcctggccctgatgcctggcagagcctggcccctgccctctcttaaccagtcctgccctggtcacaccaagctctgacccagagtcccctggggcttaagtggtggggtggcgaagggtggcccacagcctgagaagtccgcccccggggtggttcagggctggcagcaggggtgctgctggattatttggggccctctatctggggtgggggcgtcctcagtcctccctcagcgtctcatcttgcctcctcacagagcctgggcccgcttccctctgccgatcttcagccaccactcagaaccaagcccttgctactctctgacccccagtgcgcaagtcagaggccttacatccgggcacccggagcttccctgggttgacagcaggagccgaaccggattctgccacgggagacttgggggtggggtggagtggggggggggtgaggatggaggtggggaacctgaggctgtaggtcatggtggtggtggctgggttaggggtgtggaggcgttcagccctccctcagggttctgaccttgatgccagtcagagcctgggcccagcctgatacgcccgaccccgcggggtggtccagggctggcacaggggcggcgctgtattatttggggtcctctatctggggcggggggtcttgagtcctccctcagggtctcaccttgcctcctcacagagcctgggcccgcttccctccaccgatatcgacccgcccctcacagcgaggcccccgctactctctgacccccagtgtgggagtcactggccgtacatccgggcacctggggcttccctgggttgacaacaggggcggaaccagattctgccgcgggagagttgggggggtggggtggagtttggggtggggtggggtggggtggggtggggtgtagagtggagctgaggatggggctggggaacctggggctgtaggtcatggttgggttgggggggcccagcctccctcagggtcctggccttgatgcccggcagagcctgggccctgccctctcctaaccagccctgccctggtcacaccaagctctcactccagagtgcccagcagcttgagcggcggagggagggggtcggcccagcctcacaagtcagccccagatcggcccccgggtggtccagggctgggagcagagacggcacttggttctttcgggtcctctatctggggtggggacatcctcagtcttccctcagcacctcaccttgactcctcacagagcctcggccagcttacctccaccggtatcaagccgcccctcagaaggaggcctctcccttctctctgacccccagtgcgcacgtcagtgacgtcacatccggcccccaagcctggagcttccctgggttgccagtaggggctgaaccgggttctggcggagtaggggtggggatggggataggggccctcagtcatccctcagggggtcctgaccttgatgcctgggtctcgatccccattctctgcccattgggtctgctcctctcggaccaagtctctgactcccagtcacatgaggtggcagtgaggggaggggtgtggtcggggtgacaacattgccagggtcttccagggctgacaggaagggctgagctggattctgtggcccctctatgtggggaggttggaccttcagtcccctctcaggagggttctcctcctggctcctggctctttgatgaagtgatgtgtgggagatgatctgtttatgtcacctttgagcatttgcccagctgcacgcgttgcagagaatggctgcgggtcccaggctagatgctccctggggggctgcagcacctgtgattgtaggacctgtgagagaagatgcacaccatcccatgggggctcctccccagccagagctagactttgcaaaccttttgtcctaaaagatttatttttacacggaagaggctgagcagcagcaagagatttggagaagccatgtgttttgaaggtatcgaacacagcagagtccagattagcgattttcatattttaattctcattcacatggtaataaattttacactgtatgtgtacattatatatggtattgtacattttgtttatatctacgtttatatacatacctgttttagacattatatacatctatgcttatatgtatacatacacgcatatatatctttatatcttatatttacttacatgtatatatctttagctacatattcgtttgtatttctagactttatactatatatatgcacacatattttattaatatctactcatagtatgtggccttcacacatacttactattctattcctagttcattctttatattccattaaaataataattttttggaaggctggtcttctcctactaagtttgtttcaggtggttgttagcagaactctggagccatagtgtctcaatcaactcaaatttcctggtgtcctgatattactccagggctactggcatcagattttgtggtgctgcctcagattgcgcgatgatgtggggtggaatgttaaacactttctcctatccatcctgtaatctgccatctatgcagggtacagacctcctcgatttccctgctgctccctggacccaaaacacaagtactagtttagcacagtcttcagtcatccccagggctttctctgttttgatgggtttttttttttaatcttttccctcctatattttttccggggttgatttggggagcagagcacagcaacctgagcttggttgtcactttggcaatgacagttaaggcactcactctgtatttaatttaagtagcatttacatctttgccatattctgttccccatcaaggaatatggtatacagatccatttacttgagattatttcctgagtctatcagcaactttgcacagttgcttccataaaggtcttgtcaggctcttcttatttacattttggattttaatgctgctgtgaatggtgcattttctattttctattttatatactaagttgcttttgtgtggcaaggctcttgattttgctttaatgaccttctgtatgatgttttctgaagtcttttattcatttgaatattcaatgtgtctattcctttgaattttctatgtagataatcatatagttaacaaatactctatttctttgcagtcttcatatctcattttcatcttgacatccatagctctggctctttttcattttgatattcactgcagatgtaggtggtagtggtgacagcatatgtcaacgacttgtcactgccgtgaatggcagagcttctgacatttcacatttatgtatgcttgctgccaattttaggaaatggaagttccttttaatgttagtttgctaaacattgttaatttgtacttacatagaattcatttcagagccttttcctgtacccattgtcatgactgaatgtttttttctagtctatcttgtatgcagggagttagaattgaatttttttctaacatttaatcctatttttattccatgcatacaggcagcttgttcgtttaatccactgttgtgttggatatgtgattatctgtttatgacatttgctgcgatgtgtgtgaacacttgcctcacaaattcttttcatgagtgctcgggtgccttcatctgtttatgaatctaggagagcgagcctgggagaatgagttaaacaattgcccattttggatgcattggaagagttgagataagatggtgattcattttcccttgccacttggctgaactggcctccaaaatttcctgtcctggaatatttgagggtagattgaactttgaatacactttcagtttgtggaagtaccattggttttatccattcacctcttcaaggacatcttggttggtgattatgaataaactactaatacattcgtgtacacgattttccatgtgagaaccagtttccaattcacttaggtaaaacctagtagtacgactgatggatctaaaggtaagtctatgttttactacataagaaagggccaaaaggccttctagagtgaatgaaacatttttcttgtctaccagctatgaatgagaatcccacatcctctccagaatttgatattctcaggtatttgaattctatccattgtaataggtgggtagaggaatcttagtgctgttgacatttgcattattaatgaataattatggtgatcatcttttcatgtgtgtatcttcattggtgaatgtatgtgtatttctgcgtgtcttcattggtgaatgtcttcaaatcatttacatctttagttggattctttgttttcaaaggttgaatgttaaatgtttggtatttattcagcatatgagttctttatcagatatcagattactaatattttctctccatctatatagttttttccattcttctaacagtattttttttttttttttttttttttggagatggagtctcactctgtctcccagcctggagtgcagtggcgtgatctcgactcactgcaacctctgccccctgagttcaagcgattctcctgcctcagcctcccaagtagctgggattacaggtgcctgccaacgtgcccggctattttttgtatttttagtagagacaggatttcaccatcttggccaggctggtcttgaactcctgacctcgtgatccacctgcctcagtctcccaaagtgctgggatgacaggcgtcagccatcgtgcccagctgagattcacaggaaaaccacgatcggaggggtgtaagtttgtaggaaagaggtttttaagtggcagcatctttgcatgattcaaactctggaggcatatgcataaagtccaagaaacacatgagaaaactgtacttcttggaaactaaggagctcacaaatgatgaaatgtgattcacaccgatttgtaaatgagcacccatttgtaagtgagcaggccgagacagggagatccacctgcagaccatggctggactctggattaatccattcccatgtctgcattctcttatggcctcttcccacgtctcccaggactctgccacctactgtcaaattaaaaatcacaggcagggatacctctgggttctggtgtgtgggtgttggggctctctgcacgccctgatttcagagctcttttgatgtctgtgcccagttgtgtctacggtaagaacttgaatctatttcctctgatcagtcaaagaagttcgtcgatgatagcatgtgttctaagatgaacaccccaagtgagcagaaaaggctgcttcctaagttaaaacatgacatgacatcttttaaattaatttttgactccaaaagaaaggagaaggaaggaagggagggaaagagagagagagagagacacggaaggaaggaaggaaggaaggaaggaaggaaggaaggaaggaaggaagcaagcaagcacagagagagagagagatggaaggaaggaaggaaagaaggaagcaaagagagagagagagaaaaaaggagaggaaaggaaagtaggaaggaagggaaacaagaaagaaaaagtgggggcatagtgggggaatcaaggaaggaagtaaaaaaccccaccagatccagtacagacataaaagccaaacataaatcctgtccaccagacactaatgagcaccctctaaactgcaaacccgtaggactccttggtagtatgtgtcacctccacaactatcaagggcactttttaacccaatgacaaagccagacgtgatctcatctgtatgtaaagtgaagatcctgttatataaaggcaccgccatgacaaggaatggccagtaacacagagtcattgtgaaccctaggccggcaatgctagcagcacaattagcactcagcgagcaactccaggtaattttttttttttttttttttttttagacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggcttcctaaaacccagcacctgctcgagtatctcctgggcacttttccagggaggcgtgttaggctgaagtctctatcatgcaagccaaagatgtcggaggggggtactggactgcaaagaaagaaaaaggatggagaccatgaagacttttttgtgcagtcagaaaattactcattttctgacacatttattgaccagcacatattctgcccaaatgctgccctctatgtgctctggtctgcgtagtctgggtacgcctggggcccatcgctagctggcatgtactgtgacgtgcggtggctgtgggggcaatggtggtgcagagctgggagatgggggaacatgaccatggaggcagcaggctgtgcagccccagcagccactagggtcaccggtacccagagatggcaaaagggcagcatgccaggtgcaggaagtcctgtggtgtccatggcaagggtactacgggacgctgtgggaagggccaccacaggcccgtaagaattcatctgagtgggagatccagggacatagaggaagggcagcgctgcaggcccagggacagcggccaccggagtgacgtgagcctggctgccctctgaccactcgccggccggctgggtcactggactgttgtcactcgccacggcggaatcaggcaccatcacaggagttgctggtggagcagagccactcctgatttgggtgttgggaccggccggttcccggtgttgcggtgtgacctggtcattctcattcggagacgtgtgatcttgttgctcagtgtctgctggtgccagacaggatccagcagcttctggcttgtcctcctcctgatgtcttggtgcagacttgacacccactcttctcttcatcctcacgaggaggtgaggggagtctctttgaaagtaaggatggcagtagaactctaactataagtcaaagtttaaataaacaaaaggaaactgcaagtcacaaggatggactacaactaccaaccatctacgcccctgtgcaagagaactctactggcccaggaggcctttctggaaaaggtcccagtccccaaaggaagctggggactcgcgttcacatcgtcaaggtttaccaagttgtggcgggcctttccgtcttggaaaaagcctcaaaatggcagattagggtgtccatggccggcggaaagggtctttgaagttgcagaccaggagggaagaagattctgggcctcccccatgcagtgtcagctggcaacagaatgcaccccggctgggttggaggccctgggtactggctcttccacaccaggggcccacctaccaagggcagcaggagcatctgcacctcctgcgccaggcgcccttcagtgcttccacttgagcacctctccagacaccagctagggtgacagtggtacaaataccagactcccctggcctgctcacctcacagggtaatgtgctgtggagtcagggggacacagcaaccgccagatgacatggctggccccggggaggacgacacgcagatacggctacttggcacctgtgatattttacacactcgagaggggcccgcaccatcctcagccctctccccacattcactcttagttcatgtcacctccacccagagggggacacaggcccacagcgatggccccacaccctgcctgaggtcgcccacttcccaggaggcagtcctgggacttccacccgaccaggccccagagcccaccgacttaacccctccagaggcttgtcgttcattaccttattcaagatggagaccagcctttttgcggagaaaatgcgggtgaaggtcctgaaagtgcattgacgccgttttcggaagccatacaagtttagctggcggaagaagctctttatcgaagttgtggcaaacactttgtgtgcgacgtcccttttgagaatctccttttcaaagagtttttgattgatcactctacaagccccactgtcatcccaccagatggacgaaaactggttgctgctgaccagtctccacagtttctgtggaaaggggagggagaggagattatcttctccctggggcgggacgtcaccgtcagggtgcggccttctgaacgaagcttcctcggccagaggttggaaagcgatttcttctgtcagcagcctcaagttagggctcccagtggaccccgggtcgtcccaggcaggggaaggatctgctgggtgaaggtaggtctctgactgcaactggggagggaaaggcaccctttccaagccatgatcctgtcctctcgaatttctttcttcacagcgagccatactcaatgatcgcttgtcctccatctggcaaacttgctagtgcagtgtggccagcagcaccccttggcagtcatgtaaccagccccatgacatcataaaggggctctgactgccggggggtggcatctccacccccagcaagttgtgtaataaagggccaaggcagacaagtagctgcccatctgcatgtgcacattctggtcctcacagtcatttcaatgggaaagatgacactagtgcacaagagtgccgaggggccctgccacaccgtagatgcagacctggagcggtccccttgtcctagagctcctgagccaggcacaactacagcaaagccctggctcaggaaggtcagagctcaccgtctgagtcatgggcccacagaccccagcacatgactgacactcggaagcacagaacaaagggtaggacggtgcccatgggtcaggctgtagccacgccaccctttccaccctgtcctagccagaggcagcaatgtgctccatacagatcctcctaacacacccacactgtcggtccccagcacgcagatgcccgacagccccttaggcaaatggcttagctgactgccccaccacacgccgtcgccatgcagtccagtggggagtcggaggcagcctccttcctgcctctcctcggcctgcacgtgtccccccaccaggcagagacccttctacaccccgggtgtctgcggtcacatcgcggtggggcatgcagctgttggccttcgagcatgttttgttttccttggccagtgtctccagagaaacgcacgtgggtttgtgtccagcggtccatctctgcaacagttgttcctttgggattggatgctaggaggtcacgggagaggtgtccatccaaagcagtgtctgtgtcacacactgtccccacacacagggccacctctgcacagactcccccgactcgattctgggcacagagctcagtgaccttccagagactgccacgaaccggtgatgcctccacgcttgagacatcctgaccgcagggcccaaggcgcactggctcagggggtgacagtgaggggtctgcaaacagactgctgatgctcaacccggccgctgccgagctgtgtgacttgggcacgtcacttaacctctctcggcctctgtctcctcccggggataagagtagtagcacctgcttcccggggctgtgaggatccagtgggacgtataggaactagcgaggcaccggcagttgggtcagagctactgttgtcacttcacaaggcattttcttcaacagcaagtcggaaatctcatgagcctaaggcagaatccacctgtggcctctggttacaacccacaggactgaaaatccttccagccacagcaactggtgaatttcctggtcaattgccacaagtcatgagctgaaccccacttgagtttcagttcaggcagaactctagagacgactagggcaagctagacagcgactgcagagccttttgttgcagcgtgagcagtcctcagctgttgacatcactggggagcaaacgaggaccaggagcggtgaaaggacagtgtctgctgcagattgtcgtagcacccaaggaacactccagaaagcctcctaagcagtaacaagtgtggcaaggtgtagcccagccaacagtggcatctgcgaggcgtcccctccttcctcccactaccccgtataccctgggacctgtgcactgaaggactcattctaaaggctgtgcccctgcagccgccagcctcactcactggctgcctgtgccagctagagatttctttcctctgaggctggctgagaggaccactccagtttcctggcccatccagcaaagaagatacacatcatgcacgtgtaaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttcccacgcatagtcgtgacccgcgtggccgtttctgctctcagcaacattctctagtgttccggcttcaagcagcgcttgtcaggtttgaagctagccactattctgagaacgtcagaaaagcatggaccatctcttgcttggtgttgccgttgtggcagtagcagctactacgtacctgcacgagttccagggcagaagtggcaatgtcccatgaaggcgtggcaccccacggggggggggggggagtgtgccacgggcgtccacttctgcagcagaaggcatgtgcctacagcacaagcttgtaaaaaaatacttgaacagaatatgctgtacagaactaggggttaacaccgcatatgaagatgctaaaacatttgtataaatactctgtatacaagcatggagtcactcccgtagaaagggctcatccgtgaggctatgaaaaactgctgtcagcatgcccaaagagaaactacttccacagtaggaacagaaaaaaggactgtgctgtgtctaaacacgtggtgcatcagagacatagttacagttcctactgactgccccagccacgacctgggagtgctgaggacctgggagtgctcagcgagctgcaggaggtcagccctgtggagaaatacatttctaaacaatacttttgattgggatttcagcaccgtatagacagatgttccttctgggggcctggcaagcagccatctcccagtgggtctgacggggaagaggggtacctggagcccctcccagacagacggtaatcccacccctgttctcacactcttcctggcatccgcatctgctggcacacacccccgtcacctgccacttccgcgtcccgtcgtggtgagtggctgataggcgctggatgcaaacaaggcatgagatggacgtacctggagacccagctccagtactggttctggtctgcggggtgaacgagggggcagaggaaggcggagagagtgcgtcccagtccacttaagctctgtccccggaagtggcatctaatctggcatttcgatatttaatttgggaggtgggagcacatacttcccagggctctgggtaatgaccaccctggccttctttcgaaacatgggtgcgattttagggggctccggaactggggtctcttcggtttcttcattatcttcgtgatggagatcataggaaatgtttccatattctcgtagaaatgggaagatttcaagcagaaactgacagaaatctttgcggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaaatttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggttggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagcggccaacagggacctaggatgaatcccaggtttgggtgggagatgtggattttccatcaaaccctcccgggcctgggaagaatctgtcttgatccccattttgcagaggagggaacgggatctctgagaggttgcctgccgtgtctggttctacctcaaatggcagcgtgcactgcgagaaaagtcccggtgcaggccagcagaacaccagagttacggcatgcccttcccttagaaggtcccagaatttcctcagccctcactttcccacacaagcttctaaattggggccctcggggactcatcccttcctagacttctatccgccaccccccaccccctggtccccccccagacacacaccaaggacttctgaaatgctgagtacatacagtggtttcctcccttctgtccaaatgtggttgccatcagcgtgatcaacgagagccaaagggggacaaagatcgggatgcaggagaaggcgttgtggccatccagtttgtgaaccagcagaatctaaagaaagagacatagtcccggttgatgccagcaccgaaaatgggcagaggcggaagccagacttcattaggcagttcctccccaccaccccacccccgcgtgagctcccacaagagggaacatcagcaccgccagaaaaaggcaggaaaccacctatccctggggaaagctcgaaatgagcttttatgtccctcttcagagctcggcaatagcctatccacttgaaaagttcccagtgccagcagttttatggcaaactcctccgggtgtttgttctaaggagtcaacagctcccattctagaattctccacgtgactccaatacacaaatctgacatcccactctgctttccccagagtggaaactggagccatacagaggcaccatggctaaaaaggtgcactcttctccctgccagccccacgtgctgcccccaagagaaaggaaggatgctctcctttcaccgaagctccctctcggagatggctgtgttctctcccctctcctggagtgggctcactgtgagctcgagggacagaggctgcctttctaggggtgcagaatcctgtcaggggaagcgcaagcttcaggggctgaagaggcttcccgtggaacgcttacctcaaatgtaagaaggggcacgacgatggtcatccagctcagggccatggttatgtgtgtcctgcgctgctccgcaatcacatccatagagcgcaagaacaagacggaccacacaatgtagtagaggaccaccaggcacagaaaggacatgagaatccacagcgggacacacacaacctgggggtgggtgagagaacagcaagagaagtctctttagagcttccaacctggcctctgatggaaggcatctttagcaccttgctgtgtctgtccagttaaggcggtccttcctgtgagccgaataaggaccgttccatctcccaggactgctgggagcatcgctcaggacagaaaaggtatggtatgttcactatggggcctgctgccaccaggggacacacacgctcagtgagtcatcagtccctcttcctttgggtgacagacagccctgcacctggctccgcagcctctactcttccagaggcccactctcccacactctctcaggctcctctaggttctgctgccatcacagcttcccgggaaatgggacacaactgtcaccctgtgcacacacacaagatctcaccccaacagactctcttcacaggcaacattcccacaacctgctgggggtactttggcaacacaaatgggaatgggctccccagaaagtctggctgcctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcacacagccgttggcaggatgcagaagaggtctgtcaccctgcaaaactctccgtgctgtcccttcactatcacaccgtccccaccattagccccggcaaacactgatctgttctctcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagatctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtcttcatttcattttaattttgaggaagtccaaatttatgatttctctctcgtatggaccatattaacagtgccatttctaagtactctctgcctaattgcaaaccccaaagattctgtcctatgttatttcctaacagatctatagttttacattttcttttagatctatgatttgagttggcatacgaattttacttctcctgaccagttcttgattgtaggtttctctgcagagtctatgcacagcctttcttccccgttccccattctgtgatgagattctcctttttactgaagttcccttcatgggtggaatgttagatctcaataggcttccttgttttctcttgctcactatgggaaacatgtactcagactgcttcatcaactgggatctacagaggatgaagggcagaaaaaatctttcttctcatttgtggaaagctctcaaaattactaatcttttttttccctgacagtatcttatacgaaaaaatttggtcttgtttagatatgtttccttcacgtcacaacagaaacagttttgaacccaatgaccattctccagatacagcactgtgaagttgtaggatgagtgactgaatattttttattatgaatgttttatcaaagactttgggcagaagtgattattcccatctttaaatatggagtatacttaggttcccttcatttcttctctgctcccaattctttactatacttttcactttttaagggtagctatatttaatacataaaatatattgtatgcaaaattatacatcaaacaacagagaaaataaaaccgaacaaaaacactagcatgaccttacctcccagtggcaatggaactcttctgcctttagtctccatcttttttccatgcatttaatagtggaatctatactgtgttctctaatttctaccttgccacttatctttctatctctgcatccatctacccatttattcacagttaatttcaaccaaatgcccagtaactgaagtcacagtttagaagcatgacatagatgccaccaccagcaagagtgtaaatgggtatggctttttttttttttcttttgagacagggtcttgctacattgcacaggttggtctcgaactcctgagctcaagtgatcagctcacctcggcctcccaaagtgctgggactgtaagtgtaagccactgcgcctggccaggtatggcttttggaaaagcaagttggcagtgcagtatacgtatataggaatctcaaatagttcccaacctctagctcagtaacactatttctggactatttcctaagaaaacaaccaaaaaacaaaaggcaaaaattttaatgcataaacatatatactgcagtatgatttaaaatcattcaacactggcaacaatggaaataccatattttagaaataagaggatggtctgatacatgcacttgaagaatattttgtatcaattaaactttagaagtcatgtttataaagaccttttattaacatgataaaatgtttatgatacaacattaaaacaaaaaaatcaggatacaaaatggtgcacacagttatatccaaactgtttgtataaaacacagacataaaaacactaaccatgttatctccccatggtgggattatgggtgactattaggctattacttctgcttgtccgtcttttccaagctttgtacagtgaatatgaattacttttataataaaaaagaagtttatttaaggattttaaaagttacatacaagccagggccagtggatgatcttgtccagtcttaaggcaatgaatataaactggagaatgttgacagaacacaggatttctaactaaaaatgaagagaagaatcagttaaacaaagtataatttgcatttaatactgcagtaatttggttaacacactaaaagacaatacacattataatacagtgtaacttgtataatattatattgcactggaaactcctgattttcggtaccagaggggcacagcagtattatggcaaggggaaatggggctcagcctgctgccttgcccctctgctgccttgccctttctggcctgaggcctgagcacagatgagaaccttgtttccaggttcactgggaacacaggctagctgcaatagaccactaaacttccttcatgtccctaccaacaatactgtctactcgaaaccatccttgtgcatccttcttctcatacctcggttttgcccttggaccccaccccttcctttcaggctccttgaggaccttgtcacatcaagccatcaactgtagattccgtactgtatctttaaccccacctattccattgatccctcctagcagcacagaaatgactccttctcattaaaaacaaaagccccgaaaccagataaacccaccccatcctttgatccaagacccctcttagcctcaggtttctctctgcgagacagtaatgaatatgcaagcccctactatctcatctaccattcccagcttccttgtgatctggcctccacccccatgaccaccagaagacagctttcatcaaagtcaccgataaccgggaggcagcaaaaacacttcaactggcatcctactgatactgtggatgactctttcctttttgctcccctcctcctggccatctagatcccaccatacagtcttggagccctctggagtgttctggtaattccttctgtctccttttccccctccttaaatggtgatgctccgcagagccacaaactcagtcttctctcccgactaggaagacagacacacaaacacacatattttcactcacccgctgcaccctggactgggggagaagaaatttcaaccagacccttggtctgcattattacctccttcatggttagttctcacatctgtctccaacttagccttcctgctgcatagcagacccagctgtgcataggccactcggctctcctaaaggcacctcaaatgaagccagtcccaaatagagatcattatcgcctgcacttagaaccttgtatctcctctttctatagcctcccatgtcactttctatggcctcccatgtcactatggcctcccatgtcactttctatggcctcccatgtcactttctatggcctcccatgtcactttctatggcctcccatgtcactttctatagcctcccatgtcactttctatagcctcccatgtcactttctatggcctcccatgtcactatggcctcccatgtcactttctatggcctcccttgtcactttctatggcctcccatgtcactttctatggcctcccatgtcactttctatggcctcccatgtcactttctatagcctcccatgtcactttctatagcctcccatgtcacttggaggcacaacagtggtctcatttctcaagccatgagcccgggaatcaccctgcattctttttcccacactgtcacgttcagtcaccacatcctgtccactgtaaagtccagatttctcctgaatcccgtgcccacttcctatcctgatgatgactgcctagtgaggccttcttcggcaccatccgcctaccacttcagcaaccccttactaacctcccgcctccagcccaaacgccctgcaggctgctcctcactctggtaaagtacattcttgcccacaaaattgaaatctgggaccaggcccagagcttcccaaaagttctcagtacataggtacatggggaatttagtaattcctccatagacctctaggccaaaagaaatccctaatgtggctgggaatgccaacagttgcactgatttaagtaattacatctaacttagtaagtatttctaagtagccactagaaaaaataattcatataaatctaaagaaaaatgttaatattattcttaaataaccaaaactaattcccagtgggatgcgtgtgcctgtcaggtagctcaccatttcccacgccttggaatcagacaaggtgctcccactcgttacctgttcttcacccggattttcacacagcattagccttttttgttttcacagcaactgctgaaaacccagcttcttaaagatacgacgtcactgaaaggaatgcagtgtggcctaaaaataaacctgtaaactatttcaagctagtagtttgtatggtgtcccaacaaatgtcaggtattactgttttcctcaaaatgtccactatcccctggtgccctgtgagtgcactggggtgcctggggcacttcagcacatgctctgtgggctgaggacgtggcccctatttgccccaatccctctgtagaggctccctctcttctcaactcccacagttccttcctttccaccttgtgctcccgtcggatctgaatcgccacagtccactcagctgatggagtgtttcctgcctctaggcttcaatgtgtcccaaaaatgccatcccttccctcccaacacagggcttcctggcagaccctcaactcctccttcccatctctgtatgagcctactccagaccaccccctcaccaacataggtactgttcttgcatcacaggaggagggagctcagctcctggtatgttgtttcttccaagggcaggaatgcctagagtgtgaatatatgaaagacttactttctgtaattcaggcccaatgcagtcctagtccttgtatagttgtccctcagtatctgtgggggattggttccaggaccccctgtggataccaaaatccatggatgctcaagtccctgatataaactgggaattgtagggagggtgaaagtggaccatcagatactctccctccacggctcactcctacctaccactatacccatgctgtggcctttccaccagcatgaaaatcagggaatagctccccttgttcaaggccaaacccttcctggtgctctaggtcccattctccctgagtcccacagggccttgctccatcaccgtccctctgtctacataccttcccctcacgcccatacctggggtctaggcttatatgcctgacccaccctacagctgctatgtttacttcctaagccaactgcagtcttctcccttcactcttcatccacacggctcaaaaccaggcatctacagcctctagttctcccctcaacccatcagtattcagctttgggccctcagcttctatgcagttatgtagttatgtgcccgggctttagagtcgggctgactcaaacggaatcctggtcctgccccttcacatgtggccatgaacaaatgacttatcttctctggacctacctcacagagttagttagtaagaaaactaccacatgtaatgtgcctcgcacaatgcctggcacacagtaagtgctcaataaacgttatctgcaattactttcattactattattactagtcctggtattttattcatctgcatatcctctatgcttagggaaaaagggcttggcatctagtaaatacttgataaatgtttattgaatgaataaacaaacacaggggcacatcaggataagctaaccagacagcaggggaggtgctaaatcatggggtctgaggtggggagatggtcagttttgagtgtcaacttggctgggctatagtacccagttatttaatcaaacactaagcttgctgttgcagtgaaggtactgactttgaataaaggagactaccctccatagcatgggtgggcctcatgcaatcaggtgaaggccttaaaagcaaaaactgtggtttcctggagaggaaaaaattctgtgccaggactgcagtgtcaactcctcctaggtctccagcctgttcacctgccctggagatttcagacttgccagccccacagtaatgtgagccagttccttaactctctttatacatatatctgtatctaacctatcagttctgtttctgtctgattgatacaggatgtgaagctgggagaaggctgatgtcctgggtgaaaagctagtgttctaagtgaagaaagaaaaattgttatttccatcatcttttgttgccttgttgtctcatgatgtagagttggtaatgatcaagctcttcctaacaaagggtaagaaattgacatctgaataactgagcaaaatattttacttttgaaaacattctttttttttttttttaagacggagtttcattctgtcacccaggctggagtgcaatggttcaatcttggctcactgcaacctccgcctcctgggttcaagagattctcccgcctcagcctccggagaagctgggattactggcgcatgccaccacacccggctaatttttgtattattagtagagatggggtttcaccatgttggccaggctggtctcaaactcctgacctcaagtgatccacctgccttgacctcccaaagtggaaaacattcttaaatatatgaaatctcacctctagtgacctgtcatgtcgaaagccccaaacgcaagctgcaacagacaccggggaaacaaagaacagcggcatgaagaccaggagccagaaatggcttcctctctcgattctgtcacagaccagaacttcaaacatcaacaagagcaagtggatgcccactgcaatcaacatggctttaaactccacacacgtttctccttctgctctaaaaaagggagagaagaagaaaacaccctcagttcagaatctccactataagcaagcagttcagggcaaataccaacttatatttatactttgaattttacttgaaaatttgacaaaagcaaagggaaatcaggtagaaagctaacttaaacctaagctttggtaggcaatctctgaaacatcgaagaactactacataatacaaaatgaacattacaaccaaaccagaatttaatgttttaaccgtataaggatattctcaaaagtaatagccagttcttatttccctgacaatgtacataaacacttctgttcacatctttaaattcaacaacaagagttacttccaagattattcaagctgatttgcttctgctgctaaaaccaggcaaataccccttaagtctcatgatcctcatttttcaagaaaccatgtaaaccacccttcacacaatattataaaaataactctagttctatgaacaagtgccagttatatttcaagatagtagtaactattgttaggtgctatttttaaatgcaaataaaacgtataaatgattttcattttcctttctattccattaagataaattaacacctgcacatgaaagagaaagaagaacaagagttaaaactgttctcaaacaaaatcagtttaattagctaagtatcatgcacaataaccttaacagatctacaattgagcaatggtaaggccgctaatcaggaaaaggctctataatgcatctgaaaggcctacaatgtttattcaaaatacagatgaacatttatgatatacatgtattgtgggtgacaaatacaccggaagttagatcatagagaaaatgctatcagaggttattcctgtaggacccaaccatgttccactggttaatgttaacatgagaatgaccacgcctgtacattccttacattcaaccccacatacacaattcctttccttgctcaaaacatcttaaataagaccaacaaagagaagtttgaatatattctaaatatcaattagtagaacctaaatgtttatttaactttgcattctttgagaagcaattaatattagatatctgaaaatatctcataaaaaaataaaacacatacagccacacaggtcatcaatctttcaaaaaaaatctaagaactctgaaacagctatacatgaatgtccctcacctgccaaggctctctgtgtaactgttttacagttcttagacatgtatgtgatatgtaatttacacaatctgaatcattttcatatttagtaaacaaaaatttaaaaagttgatgtagtggccggacgtggtggctcacacctgtaatcccagcacttcaggaggccaaggcgggtggatcacctgatgtcaggagttcaaaactagcctggcatggtgaaaccctatctctactaaaaatacaaaaaattagctgggcatggtggcaggtgcctgtaatcccagctactcaggaggccgaggcaggagaatcacttgaacccgggatgtggaggctgcagtgggccgagatcacaccattgcactccagcctgggcaacaagagcgaaactctgtctcaaaaaaaaaaaaaaaaaaaaaaaaaaaaaaaggtgcggtagtttcaactttacacttttcccacatgagcagctgccttctgggaattcctgtactcctcattttcccagtggaggttcataatagcctcccagtcttaagtccccctttttccctttatgtagttacagtctctgtggcagagaagggaaagactctcgcaggtcccagcaacaagcaggttgcatgctggcgtgagccaactcccaggaatttgggccagcggaggcatccaagagcagggagggcaagagttggaaacggtaaagggtacccctctcccctgcccccaaaggctctgctttccttctcggcatccaatctttgactttcctcattccccagctgctgtctcagggactcatggtctcctggtcaagccacctcccctacactgctaatagtcctaaagctctgggactaggagggtgggacaaggggagccccagttccaaaactgtattggagaaagatctttcatgaccaaacataatatgagtgtcttttcctaaaaacagggtggtttcatgctgcttagtctagtatggcataccagttctgtattttgggtgcattttggattatataggcatctgtgagctggctggcaacttacccccaaatggcactgcttttgtaagaaaatacataccaaagactaaattttcaaaaacacagaagagatctgttagcttatactatagttctaagaccccagataggtagaaaataaaatggtccttacttcatcaaaagtgagaaaagtcaagatattgctccctcatgctagagaccaatgggttgtataaagcagtattaccgatattgaggatttcgtgcccagactccagttccaactgaggctccaacaatgaccattaacttccacagccatattggagcaaagacagcccagtaactccactgtatgatgccatccaaacgaagggccagcagcacagagaacagcagcagacaggcatagatgaggaatttactaggagaaaagtaaaacgattaagaaggattcacttttacaaatatgtgatactgaaatggggagtaataagagccacatttgtcagcatgtaaaaggagtcactaactcaataatcatttattgaaaaggtctatggggcagacataatgtgttgggaataaaagaaacataaagaagactaaaataagtctcctgctttccaaggcttcctcatagaaggaagaccacacagaaacatataatacagcacaatgtttgtgatgagagcttggaagaggaaatacagactgtgtctgaggaggcactcagaagcagagatgtggtgaccctagagctggttccagagggcaagtaggaagctgccaggcaggaaagcaagtgagatgaggaagtattccaggcagaaggaactagctataccaagacacagagactggaaaaggctgacatgctctgaaaatggtcaagttctatcactaactgattctatttctaaaaaggcagccatctgtcatattcatatggcatgaacattttagtgtatgtattatactttccatgaatgaataaattacacatacacacatgctcacgtctcatataaaagggaattgctacagaggatgtccttgaaataattagaaattatactcttgaggacctctatttccagccttgacttaataataggaatataatttaccttcccgcctaaataagaagcttgatacagtctacaaaagaacagttttcagacattgacaacaggcagtggagaacaggtgagaaggaggaaataaaggaggtaaaccctactattgccccagtttgcagatcagaggcagtttccaggctgcagcaagaaaacagttaaaactcaaccctgtcaataactatattaaatataaatggccaactgaaagacaaagatgatcagattggataagtaagcaagacaactatatgctgtctgtaagaatcccactttatctatctataaagacacagatagattaaaagcaaaaggaaagaaaaagttataccaaataaacactaaccaaaagaaagctggaatgactatattaatatctgtttagtcttccattgctgctgtaacaaattaccacaaacttagcagcttaaaacaacgtaaatttattatctcacagttctatatgacaaaaggcgagacgggcttggttggtttctctactcagaatctcacaaggctgaaataaagatgtctgttggtggaatgcttatcaggggactctggcagaatctacttctaagctcattcaggttgttggcagaatccagtttcttgtggttgtaggactgaggtatgtgtctctttgcttgctgtcacgcagcagctgatcttgcgatagtaggggcctctcctgggtccttgtaaataggcccctacatctcaaagccagtaacaagctatagcatattcaatctttctcatgcttgggatgttttctcactacttctgccatatcgcttctgcttccactgagagaaagttctccgcttttaagagttcatgtgatgaaactgagtccacctggttaagccaggctactctccctattttaaggtccataactgtggttggtaggcagaattctaaagaagtttcccaggattcctgtcccctgattattcaatcaaacactaatctgagtaatactgtgaagggactttgcagatggaattaaggttactaatcagctaactttacaataggaagattatactggattatccaggtgtgcccagtgtaatcacataagcccttaagaaagcagaagagtaagtcagagaaatgtggtggaagagagatgaggcagaagtcagagagattccagacttgagaaggattcagcctgttacttctggctttgaacatggaggtaaggaaccatgagccaaggaatgcaggcaggcttcagaagctgagaataactcgcagctgacagccagcaaggtaaatgggacctcagccctacaaccccaaggaactaaattctgacaatagcccaaatgtgcttgaaagcagattaatccctggaggctccagaaaggaatagagccctcctgacactttgattttgaccctgtgaaactaggcagaagacccatctgagttgtgctgtacccggacttctgacctaaagaactgagagtaatttgtcatggtaacagcagaaacgaatgctaataaatatagcttcaaagtcccctttgccatgtaaaataataacatattcacaggtttcagggcttagggcctgggtatctgtgtatttgtgggggtggggcattctgcctaccacaacataagacacagtatatttttgaacaaggactatttccagggacaaatagaggtagttcataatgataaaggggtcaatttgtcatatgcctaataacaaagtttcacaatacatgtagaaagtactgatcaatctaaaaggagaaataaaaaaatcaaactgttataaatggaaattaacattcctttcttagtaactaatagaacacataaacagaaaattactaaggatatatatgattgtagcaacactatcaaccaacttgacctaattaatattaatgagttcctcccaacaaaagcaaaatacagattcctttcaaacacacacggaacattcaccaagatagattgaattctgggccataaaacaaagctcaacaaatttaaaaggactgaaatcatacaaagtaaacaagcacaatggagtcaaactagaaatcaacaatagaaaaatatctggaaaattctcaaaatacttgaaaattaaatgccacactgcgaaataatccataggtcaaagactatgaagaaaattgaaaaatattttggactaaaggcaaaaacacaatataccaaaatttgtgagatacactaaagcagtacttaagggaaattttagcatcaaatacttacattagaaaagatatcaagtcaataatctaagattctatcttatgaaactagaaagaacatggaggtaaggaacctccatgtaagaaacggaaggaaatttgtaaaaagtaaatggaaagaagaaaatgataaatgtaagcacattaatcaataaaatacagtaaaaagggattagagaaaaaaatcaatgaaactaaaagcagtttctttgagaaagtaagaaaattggtaaatctacagccagaataatcagtaaaaaagagtaggctcaaattactaatatcaagaatgaaaacagggatatcactacaaatcctaataatactaaagggataagtaggggatattataaacaactttatgccaggaaatttcttgaaacaaagacatggaaactgcaattctagttaaaacctttttcagaaagaaaatgtcaggccatggcaaaatctaccaaacatttaatgaggaaataccaccaattcttcacaaactcttgcaaaaaagatgaggggggaacatttcccaatttattttatgaagccagcattaccctgataacaaaactgacaaagaaagaaaactacagaccaatatctctcatgaacagagatgcaaaaatcctgaaaagattttagccaactgaattcagcaatatataaggatactacattacgactaggtgtggtttagctaggattgcaagattgcaatcttggattaacatttgaaaatcagttagcaaccttcgtggtattagcaggctgaaaaagaaaaatcatatgatcatctcaatagttgtgtaaaaagcatttgacgtaatttgctacccattcaagttaaaagcgttaaacaaattaggaaaagaagagcatctatgaaaaacctgcagttataatgcttaatggtgagagactcaatactttccccttaagacaggaaacacagcaagtatgtccacttcaacacatctattcaacattgtactaaaggtcctagccacaacaataagatgataaaaagaaattaaaagaatatagttttaaaagaaagaagtaaacctgtcattatctataggcaacatgatattccgtgtaggaaatcctaagtaatctaaaaaaaagctagtagatctagtaagtgaatttaacaaaattgaaggacacaaggtaaatttacaaaaattattgcatttctatatagtagctatcacaaattggaaacagaaatttaaaaatatgtatcatttactgcaactttcctataaatttataactattcaaaaattaaaagtttatgaaaaaatccaccatttacaatagcatcacaaatataaaacacttagggataaatgtaacaacatatatgcaaaacctatatactgaaacctacaaaacactggtaggactgtggggaagctaataaacaacagaaatttattcctcacagttccagaggctggaagttggagatcaggatgccagcatggctgggttctggcgagggctgccttctgggtggcagatggcagacttctcaatacccttcacatggtgaaaagagagtgagttagctctctggtctctttttataagggcactagttccaaccatgagggttccaccctcataacctaatcacctcccaaatgccccacctccaaataccatcacactggggactagagtcaacttgtgatttttaaagggacacattcagttcataactgccaagaaaaattaaagatctaaataaatggagacatatactgtgttcatagaacactcaatactgttaagatttacatcctctgtgtattagtttcctatgggtgctgtaacaaactaccacaaaattggtgacttaaaatggcacacatttattatcctgaggccagaggtccaaaaagggtttcactgggctaaaaccaagatgtcagcaggacctactccttctggagactctatgggagaatctattacttgtttttttccagtttccagagctgtattcccttggctcatggcccctttctctatcatcaaaaccagctgcataaaatcttcaaatctctgtctctgtttccaccacactgccttctcctcttaatattatctccctcttttaagggaacctgtgattgattgcatttattgccccacttggataaccccatcatctcaagatctttaacaggttccatggaagtgggtatctttgtgggtcatgatttagcctaccacacacaccaaattaaccaaattattttaaagaatcaatgcaatcccagcgaaaattgggagccagcaggttcttctgtagaaattgacatactgactttaaaagtcatatgacagtgcaaaggacctagaatgggcaaaacaattctgaaaaagaacaaagttggacaatttatactacatgctttcaaagcttactataaagctacagtaataaacacaatgtagtactggcataagaatagatatatagaacgtactagagagttggaaaacagacccatacatatagagtcagttaattttccacaaaggtgccaaaacaactcaatggagaaataattatgtttcaataaatggtggtacaactggataaatgaggaaagtacaccttgactcttaaccttataacatatacaaaaatttatgtgacatggatcatagacctaaatgtcatacacaaaactataaaatgtccaaaacacatatgaaaaaaaaatacttgcaacctacggttaggcaaacatttcttagatgggatatgaaattggacttctccaaaatgaaaaactcttactctccaaaagatacctatcattaacaaaatgacagccaagccacaaactgggagaccatactctgaaaacacgtatctgacaaagtaacctgtatccagtatataaaaaggacttttacaactaaaaaaataagtgaacaacccgatttaaaatggccaaaaaattcagagacatcccatcaaagaaggcatacaaaaagcaaataagcacacaaaaaatactcagtattttcagatgttaggacaatgcaaactaaaacgacaatgagataagattacacacacactagatctcttatatatgctggtgggaatgcaaaatagtacagccactttagaaaacattttggaagtttcttatacagttaagtgtatacttattctatggcccagcaatcccacacctaggtattttactcaagaaaaaggaaaacgtatgtccacacaaaggcctgtattcaaatattccaagaagctttattcataattgccactggtaacaactcacacatccataaactggtgaatggttaactgaattttgatatatccgttcaatggaatactaatcagcagtaaaaagtaacaaactatggatgacaacaacaacattgatgaatctaaaatgcactataagtaaaataattcagatggaaaacacaagatagtgtacaatgctacttatttgacattctggaaagggcaaaactctagacacagaaaaacagatcagtgcggttacagataaggaacagaaagctcagatgttaaataacttgtctaagagctcagagttgggagtcaaaccatttgactccaaaatccttctaattgagtattatactataccggctttacactgataaatgaacatgtttagaaaagcatctgtataaatatctgctgagcagctaacaggtctccactcgggaagattaaggatagtctttatactcttttgcttatgatatctgagttttctgtaaggtacgtgtactgtttttgtactatgaaaaataacataagaaacttcgattggaaaaaagggaggagggttgtaagaagactggacctacaaaattaaacttggaagcaagcctcccagagagaaaactacgctgggaagatcatgagattcagaggggttgctaaaaaaatatacatagcatcattgtgtcatggtattcttacccataaagttagggcaataatatgtacctcataaggtggctacgaatataagataatgagtataacaagtgctttgtataaagcactaaatcagtggctctcaaagtttttagtatcaaaaattttgacgtttaactcttaaaaagaactccttttcagttctaacacttactgaggatcccaaagagctctggttgatatgggttatccctattggtatttaatatttacgatacagttgttattcaaaaaatatctactcttcgaaggtaataataaacacattacatactaacataaataacattatttaaaaacatttccaaaaccaacacaaatttagtgagagtagcgacactgtttctacagtttagcaaaatttttaatgtatgatatcatagaagacacctagattctaatatctatatttacattcattctgttgcaatacattgttttggttcaagtatacaaagaaaatctggcctcacagagatctgtagttagaaaagaactattttaatagctctttcagataatggtagacgttcttcaacaggacactaaaactcaacaagtggtagtttcttaaaggttaactatgatgtggaatctgaaatcgtatcaatgacctttttgtactctgctacactgaaatccactggtctctcttatactttcaatgaatcttttatcccagcattattgtataatgcaatgtaggtcgactggaaaatattggtttactgagttataaagatctttcaaatgttgacacatttcatatacaatagcaaaaaaaatcacattacttactatcttcaccaacttcatcagaaatattttaattactgggaggttgtcaagctcatggtagcagatacaacttttcaaaaattctggttttcccatgaaagatcaaattttaccatttacaaaaaataccatgagttgttttccttgaagttttgcttcctgcactttctttttttgtgtgtgtgatagaagcatcttttattatagtatttttgtctttttttttcttttttttattattattatactttaagatttagggtacatgtgcacaatgtgcaggttagttacatatgtatacatgtgccatgctggtgtgctgcacccattaactcgtcacttagcattaggtatatctcctaatgctatccctccccccaacccccaccccacaacagtccccagagtgtgatgttccccttcctgtgtccatgtgttctcattgttcaattcccatctatgagtgagaacatgtggtgtttggttttttgtccttgcaatagtttactgagaatgatgatttccaatttcacccatgtccctacaaaggacatgaactcatcattttttatggctgtatagtattccatggtgtatatgtgccacattttcttgatccagtctatcattgttggacatttgggttggttccaaatctttgctattgtgaatagtgccagttagaatgtcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggactataaatcatgctgctataaagacacatgcacacgtatgtttattgtggcttcctgcattttcaagaaaatgtctgccaaacaccataacacaaataaccacagtcttgtctgtcagttgtccttccaaataaaaatgatactccatgaaaacagcagcttgtaactcaggcacacacgtttttccttgagtcaaccattgcacttcagcatacaacaggcctttatgcattcttcccatttcatcacatggaatattaaactagatgtgcattcaggggtcaagattaaatgagattaatatttttctgctttatcaaggacattcgtaagtgaagctggcattttttttttaactgcaagtccagcacgtggtggtgaagaatccagtgacagaagactagtgcagctggtgccactgtcctgatttgtgctccagcaccagctgtttgatgcactacttttgtaccaccagtgccaatgtcgaccaaggcaaagaatgtcttagtattataattttgactttgcagatacctggaaagggtctcaaggcccactcccaaggtctgtgggaaacagtctgataaccagcgtactcaatacacattagctaataatattaatactcgaaaacaaaaacaggcttttataagctgctacaaagaaagaacatttaaagaaaccaagataaaaatgacttcatcccttagactttggacaagaagagagcctgtgtcaaggtgattcacaagttaatagaaatggagttatcaccacaattacagtacacaattagtagaggcagaagttttctctcttaaagcagagggaaatattccaaaatctaaaaaaatcagaaccaatttgtcaactaaagcctgtggctacaaatataattaccagaaacaatggacttgaaaacagactatttaaaaaagaaattagtggattcaaacattaacaaatgctaagataatgacgacacaggattcatatgtaaattagataacatgtacaggtaatttttatcctaaaggattttcagactataaataaaaagtaaattggtgggggggggtggtaaatgctgtaagctaacttcattatcctctgtaaaacagtttccttatttaataaaaaaagagagtagtggaactaaagaaaagagaagtaccaaaatgttttaaatgttggaaaagggattattttatgtggtttttgacataatttaaaggaaacttaaaattttatgtctattacatgaaaaatagaaaacaagataaacttacaaaaggacccacaaaatataattcatgattcaaatactagggttagaaaaatatacatgagctgaatgttctcttattaatttcctattgctgccattcaaaactgccacaaacctagtggtttaaaaagcataaacctagtggtttaaaaggcataacccttacaattctggaggtcagagtccaatatgggtctcgctgggctaaacttgaggtgtcagcaggactatgctactgaaggctctaggagagaatgtttctttgccttttctagctctagaggctgccacattccttagctcatggccccttcctccatcttcaaagtcaacaatggagaatgcagttcttctcatactgaatcactctgacctccttttctgtctccctcttctatatttaagggccctgtaattacattgggctcagccagagaatccagaataatctattttaaggtcagctgatgagcaaacttaattccatctgctaccttaattcccctttgccatgtaacagaacatattccctggttccacggattaggatgtggacatacttgggggcgtcattattctgcctaccacagctctgtaaaaagaaaggttgcttcctagattaagaaagtaaacctgttacattcaagagttacgcttggaaccaaagtcaaaagtcgaaccaactatcagaaatcagatgacagaggtttagcacgcctggatgaagacaagagcaacaatttactatctttaaaattagataaattagatttcaaagccgaaagtattaaaatgctaaaaggactaataaggaaaacctaaataacaaaaacctaacatgaccatggaatatggaaataattttacaatttttcttttttaaggatacacagaaatattttaattgtgggcttcctcatgctactcttaaatcatgacagataaaacagacaaagttcctaaggaaaatacggaaatgaacacaagagtagatttaaaaaacagcaaggttatatgaagagaattaagtagcagaacgagaaaatttaaaaaacagcaagcttatatgaagataattacgtagcagaacaagaaaacatacttgctttacatatatatagtttttccagggagaaaaaaaggatcatggggcagcaatacacaataaacacacatctaatttacaattgttaaaaatatttgagtgcctgaaatgtgtgagatacataaaaaggagcaacaatgcgttcgctcaagatgctcagactaataggaacagagggagatgatgtatcaacaagtaactacatatggtaaactaggggacttggaagattaatttccctgagagagatgggaagagaagtggaatctgggcaacaagttgggaataaggaattccagacaaagggaataagatgttttccaattttttaaaaattatttttatttattatggatacaaaacagttgtgcctatttatggggtacacgtgatactgtgatgcaagcatacaatgtgtaatgatcaaatcagagtaactgggatatccatcacctcaagcactgatcacttacttgtgttaggcacatttcaattccactcttttagttatttgcaaatatacattattaactatatttgccctcttgtgctaccaaacactagatttattatttctatctaactgtattattgtacccattgctcatcccctctttatcctcccctctccaattccagcagactggaacacacagaatactttctataaatcgtggtgggtagggtgctgcagagacaggagaaagggtactggggggaataagccagaagttggctgtggtaacatggtaggggaatgtgaatatcaaggtaaagtccttggaatttattaataggtaatatggggccactgcagattttctcaacaagagtgacagaagatacatatgagtgtgtaaggtagattgtaatcagtagagaccagaggtagacattttatacaattcataaaaacactgacaaaaaatggatcattttcaatactgatttgttaagcagtttagtagagttactaaaatacaattgaaacataaaaatacctgggcagctgccaaaacaaaactcaagagaaaatgtgttcatttaaaatgtttaagtaaaagtagaaaacaaagaaaaaaaaaaagaggcaaaagaaaactagtaaactgagtttctaagaaatttggggaaaaagccaaaacatgaaaataataaaactaaaagtagaaatatagatataaaaatgaaactgatcagtaatcccaacagctagctttttaaaaaaattaaactacaaagttgatcaagtaaaacaaagtaatacaatcagtaagttcaaaagatgtaattcatacacactcctagttggggaaagaaagaatagtatcttaactatatcaatatatttgcaagcaaagtctaaaaggtgactgcatagccaaaaggaaatatcaagcctgatttgcaaaagaatacacaataatatgcaataatacagtgataagaaaatgtatttacaaaaataacttatggtcatagcctaaactactttgagttacttttcaagaaacattcagaccagattccaagtataaaaatagactgcttaattctccacaaacctgggagaaatgggaggttctggtttaacattaatcactacttcttaaaattcacttttccagttacacctttagaatggatttattccactctcatttgaatctgtagtgttagtatacgatgaatcactaagtagtgctacctgggccaaagctagtatcctctctgaaatttacatggagctttctgctcaggctcaaattccctctctccactttgcagggttgggagaatagggagggagaaaaggaagaagggagggagagagagaatatacttagcaaaggaatgatgactctgaatgtaaaagttctagtatctgttttctgcatatcataagaatgcagctggactctttttagacctatcagtttttttccagtggaagctgctggcttcactggagcacatacacgcgcattaacacatgcctgcatgcacgtacacacgcacaagcacatacacacacacaaactttggatggcacatcccagtctaaagcttgacagaatggctccaaatgacaacctgacatactcacaaactatcaagggaactgcccctcttacaccttattaaccaaatttaaagtcttttagtggagactttagctggttttattaagataaaaaatgtttaagagcatttaaccagtagatacaaaaaagcacaaaagccaaataaaagcagagcccaggccagtaggaagatctgcatttaagttcctcaactgccattcatcagcggtgtggtcttgggtgagttattttcccccaggtctgtctcctcatctgattcctcatatactgattcattaagacaagggtatgtgaaagcactgtgtaaatgatacattttacccattctagctttagcagtattatgaaagacaaaagttctgccacattgtaggtaataatctcatttagcaatcattgttgtcactattaggttggagctgacaaagtatgagtctccacttataaagcatctatctccagagttcgaggcttttgtcttaaattccagtcatcttgtacaggcatgacatatcaggcaaaatgattagaaaactcaagctccatattaaaaagcttaacttctggagtcctaggaaactatctaaaactccttcaatccacggtctctcctgtacaacaaagacttcccagtggtagatgtctatttgtacccaacatccactcattcagcacgtaattcagcacctccaaatcctggccctcaaagaacacagctaagaacaatgtgtgtgtaattatcaagtaataggaatgatacttttaaaactggaaattatacattcaaatgagatttctctcctttaaccagtccccttgggaggcaatgcagtaattccaatggtacttcattactcaaatcatctttgaagctttcttcttggaagcaccttgagaacctgcagtctgatcttctgactatcccaaatggtgctaaattttcactgagggtggattcaaattttggaaatggcaaacagtcagtcagagccaaggttagtgaataagatgtgtgatcaaactaggtggaactattttggttgaaaatgatagatgatcataaagcaatgagatggatcttcttatgtgatatgtaaactgactttaaagggaattccagatgagtaacaaggagtatgaacaatggaataggtgtatacattctctttccccaagtaacctctttgaataacaacactcatttggatgtataagcgccactaacaggtttgttttgtttaatcacttacaatttgtaaatagagggttccttagcatactggatctacaatgtcatggaggaaaggagttgtcacttaactagaactatggcatggcacgcaggaaagagcacaggcttcatgagactgacgtggattcgaatgttgacttagattcttcctgcctatgcaacttcagggaagtcacaagctgtcaagactttaaaataaggctgatacctaattttgcagggttgttgtaaagatcatggataatggatgcaaagcccctacattgggcctggcatgtggtgggtactcaagaagtcacagctattattaacagcaacatcagtaaaatcaagaccattttctgactgtaggtggcttgagaggacagaacaacagataagcagtcacttgagtggtaagtagttcattgacagtactgacagtacactcgtgcattagatactgctttcttaaaaacaataacctgtaaaaactatttgcagtaactatgtatttttaattcatacgacacatatcatctgcagtgctcataccacatggacctcttcactacctgaacataccaggcactatcatgaccccatgcctttgtgtactttgtcccttctgagatactgaaaggggccagcccctccacacctgtgggtatttctcgtcaggtgggacgagactgagaaaagaaataagacacagaaacaaagtatagagaaagaacagtgggcccaggggaccggcactcagcatacggaggacccgcaccagcgctagcctctgagttacctcagtatttactgatcattatttttactatcttagcgaggggagtgtagcagggcaacaggtggggagaaggtcagcagggaaacgtgagcaaaggaatctgtatcatgaataagttcaaggaaaggtactgtgcctggatgtgcacgcaggctagatttatgtttctctttacccaaacaactcagtgtagcaaagagtaacagagcagtattgctgccagcatacttcgcctccagccacagggtggttttctcctatctcagaatagaacgaatgggaatggtcagctttacacagagacattccattcccagggatgagcaggagacagaagccttcctcttatctcaactgcaaagaggccccgctctttcactactcctcctcagcacagacactttacgggtgtcgggctggggggtggtaaggtctttcctttcccacaaggccatatctcaggctgtctcagtggggggaaaccttggacaatacccaggctttcttgggcagatgtccctgcggccttccgcagtgcactgtgtccctggttaatcgagaatggagaatggcgatgacttttaccaagcatactgcctgcaaacatattgttaacaaggtacatcctgcacagccctaaatccattaaaccttgattcattacagcacaggtttctgtgagcacagggttgggactaaagttacaggttaacagcatctcaaagcagaaacaatttttcttagtacagatcaaaatggagtttcttatgtcttccttttctacatagacacagtaacaatctgatctctctctctcttcctcacaaggtacccttcctactctctggtctgatgacaaccctacaattctagctcaaaagtctggctcaaaagactagctcaattcaaaatctagctcaaaagtcatttccactatagactcttccctgcctgctcgagacagaattagtagctctgccatttgtacttctaagacatttggtttctttcactgtaatgcctcatactctattgaattcttatttccctttcatttctgcttcttccactaggcttacgcattgagaggaggactatattcctttatttttgtacttagagcacctagtacatcacttggcacgagataggaatctagatgtttgaggaatcaatgttataatatactttgcaaataactgttagaggccaggtagctgactttagtgaactatattaccagcaatcgcattcctttttcctgcttcaaacaagagacaagataacttatatggactccagaatgtcttctgaagatggagcatacagaagtctccaaacactactgatctcatcagtaccccatgcccacaagttggaacccccagagcaacacttctcagcctttgttccagtctagcacacctgagggatacaccacactcccatcaggagctcacaacagatgactaagaaggcccagcagagttttcacagccttccagtgccacatggctaccagggtggaagggccttctctgaaccagcaactcccccaaagtagcagaaaatttcaaggctccatggtgagtgccgggagcccacctaatgctacctactaccagatccctaccacctacaatgcctcagaatcagtttgcctactctaagaacagggctctttcactgttaggaagcctcaggcattcaaggaaggacttgtttgtgggtccggtacatctgtttcggcatgtcttaacctgcataactaaaaagcaattatgaaaagaagttcatgatcaaccagttcagtgccagatggaaataggtagagtgggtcagctggcagccctgtacatctgagtgttgacacttgtgaatcattctctgtcactatagtttccagagccttgccaacgcagcagtgggttcagacttaccaagatccaaaaggctggaaaggggatctggagccatgacccatgccttgggacccaccaaaccatgacagtgactatttctatgacaaagacatgctcttcaaagtaaatatagccatattctgccttagtgccatgttctctcccatctctccaaagcaatggctgcactctgaaggtgggaagagtgtgagaagaaagagaaccaggccacagaccaccaggaaagcagtgattgaaagcagcagctctagatttatcttataggctctggagagttattcagttatttactccacaaatatttattgagccaggtactattccaagtatgcaggctacgatactgacacagtcacggccttgaccccatggagcttaaagtttagtgggggaggcaggtattaatcaaataagcatccagacagacacaagggtacaaatatgcactatgatggaggagtagtaaatactacaggaactgtagaaacagggagcagtaaatctggtcagggaagtcaggaatgcttcccttagcaagtgccaagtgaggataaataggagttcactaggtctggaggagaggaaaagagagggaaacattcctggtaaagagaacagtgtgtgacaaggtcctggggtaggagggagatgttgaattggttcaaaaatagaggcagggagcaaagcagtagcatcaaggtttgagtccccagcataaggtaacttcctgtgtacacccctcagttttctttctcctatagagaaggccttcctcagcatggaaggagactaaagcacactgtcaaaaactaggagtgctcaggagaggtgaaacactaccagctaaaaaaacaaatctgatttaccaataatacctggccaatgtcctcttgaaatatctgtaaaattaaggaactcactacctctggcaacaatgaatcaggaaaatggcacagtataaaagacctttaaacttttcaggtagaaatacattttaatgcaggtagaattaagagattgatgaatatgttgagaattactataaatctgcttagataccaggtatttcactgtaatttcatatactaatttttttggggggaaaagggctaaaggaaaaaacggttaaaggtagtatcagtgcagcactattttgctttggcaactccgttagcctgtttgatcacttaaggcagtttcttgaggcttctgaattctctgtcaccttgcaaacaagtcactgtagctttctatttgtaaggcactttgtaatcaatccttaattggcctccctaccccactgagagattatactcattctacagataaaacaatagataagtgagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagggcacatacaaagtcacaatgactcacaagttaaaatgtcaccatccctagggagactgcaccctcaacatacaaatactcccctaaaacttcctttcatcctcaacaagcagccaaggcataggtccccagagttggcccccgcagtacagcactgcacagtactgtaaggcatcttaagtgtacaagcccttcttcaccccatgctgagaccgccagcatctaaagcacctaacataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcctcatttttctaacccagttcagagcctccttggatcctgtctaaactttgtggtcacttcacacctgacctctgcctccactccaggctgccctacttacaagtaccaggttcatcttccttgggcaagtcaacatctttgagtctcagtttttctcctccgcagaatggaaatgataaaaacctcttttctaagcgtgttaggaagattcagtgagatcgtgtgcataacacactgcctggtacatgctaggtgtacaaagaatgctgttgctatctggtactctttcaggtgtcaacctcctcaaggattttgtttgcttttggaatccaagagcaggacaagctcatagcaggtgacctagtttaccatcttcactttgggcagatttaagttttcatgagcacaacaatgccttaaacattagtctactatcattatggataatagtcatcctttgttgcaatagcagagtttcacaaatgacaattttatactgtttagccccaagggcagcttgagagaatcacaattgcgatagtcatacttagtcttgatgtatcacctttcttctgagaacgtaaaaacatatcataagtggtaattaagcttcccaacacccactgggaaatggatattattatatgagctgattttaaggttgagtaatccaaatcaagttttcatctgctgaagcaccaggaccctgtcccagactttttcacccatcttcctttcccatcctctgggtaaagtccaatgtgtagcccagaggaggttctcaatgaacactcaaatacagacgaggaattaaggcgcagagaagcttgtataacaggccctgagcgagccagcaagtaagggtgaaggagcacagatgaaactcagggtctagctgaacctgcagcccatactgttagaaagaggtgcttgccagtggtcagattggacagcaccatcttcattaccagtgaccgtgccccaagcaggcatgagaagatggtctgccagttcagacacttgaataacaggcatcactgccctttcaagagcttcatagatagagaccaggcaggctcctcagagtccagaatcttgagggcagacgctactttaatgagatcccagggagtctgggagctgaaccactgctctgcaggcccacaagttcaattttagcagttcttccagagttgaccaggccctggaagctatctagcaaaggcaacaggacactgatgcacaaattacttgtcagtgtgttcttttgctctgacaaggtaaattgccaagaggaacatatgaacctgtctgtgaggaaatacaggaagaactggactttcccaaggcttcacatccccagtcttcaagaggtggattacctggactgattctggaagcccaaccctttatgctactggtgctctcatggggaaaaaaaagccagaaaccagatggccatctggtcctctctccagcaagtgcaaaagaccctactgacaacctgctgctcacttcagagccctcactcagtgtcccaccctagatggaggtccaaagcctcaatgacctgtgtagacagacccacaagtgatcctgacattaaagaaagaccctgggtcatatgcaggcaccaggagtgctgggaagcttaattaccacttattaaatgtttctacattctcagaagaaaggtgatacatcaaggctaagtatgactagtggagaagatgacacccacatcttctccactagcagagtttgactttatcttttccttgacttgccaaaaaattccagggctatcttgctaggggctcccaacattcttcactcaaaggaaagaaatggctctggattgaaaaagtatgacccccaaataagccagacagcatattcttgtgactttggggtgggcttaggttacagtgttccagaagaatcagtgtatatctgaccatggttttaaggactaacttggatttgtaccacccttctgataagctggtggcttgtccaattcaatattcacattggcttcaatgtggtgatataggatgcctctcctctgaagagcaaggcactggtgaagagaatcctggtgaatttagacacttggactggggagacctggcataggggaagaaaatggccgtggaaccgccctccacacaccaccaaggctccttccctggctgcagcagtagaatggagagagtgtggaattagtagatttgaactcaacaccagtttcacccttgctccagtggagggagggccagctgggatccagtcccgtgcaaggcctatgggactataaagagcttctcggaggtcagattgacaagttctttagccaggaaacatggaggtgccagcctgcaaggctttcttagcctggaattcctcaccctaggttccctaaagtccacactttgaatgccaccaattagagaattgctgaagatgctgggaattagtccacctgcagaatgcaatctcctgcttcctgacagaaccctttgtttcaggcaactttagcctaacttggatacacatctgagatctccctgggaggtgggtgggtctggagtctagacagggatttgattaaatacggggctagatttaggggcttggagaactggaggaggagattgcagggaggcaactgaagggaccacagaggtagtagctgtagttctgcttggacttgcagcaacccctatggccttccagagcccagaaggagccacctcctcagggagtcttccctcaggtaggcaaattacagttactgagagagaagagggagggaggacagtcccaaggccccagtggacctcctgtcacccagggtagccctgggagtgggtggtttatcatccctcatggagcaagctttctgctaaaggaagcaggggccatttcctgttggaaggcagaatggggagcctttgcctgggccagcaaaccaccacggtatccctgtgcttctcctctggacctctcctgatgccagggtttccaggaagccttcccggctgtgccacactcctccagtgtgctgtgtatgcaaagcccaggtcaagtgtgtgtggccaagcacacggggcagacaaaaaggcccatgcttgccaaaggtcaccaaccagctgcccacatgattcctttttctccttgttcccaacctgctctcattcctgaatctccactcaatgcttgtctttctccctttctgtttccacactgtatttctgacacattcctctggggccctctgccctaactaatcaaatgtgctcttcctcatcttgccttcccctaatggatcctttcatcttgggtagcctgtaaccttcactcctttagttgcattcatctgacatatgtcttccagagtgtctgctttgtgccgggcactgtggaaggcactgggaacacacagatatgaataatgaaaacacagcattgtgcacgataagcattggggatgagggaaccgctgagctgaaaaaataacattgtaaggtaggaagagaggaaatgaggttccaggcagagtaaacaacagttgtaaaaacacagaagtcagtgaatggaggcaggtgcaccattttggagaacaatattgtctgcaaccatcctcccttcccttcccaccaccccactctgcctacaggcagctgtgcgtgtgctctcagctctctgtgcttggaggagtcagttttggagtcccatgatgcttcccactatgcccctgtattcttggatcctggcatgcagtaggtgctcaggcaatggtcatgaaatgaatgctgatgttggacagtcacagggcacaaacaaaaaagcagttcttcctcatcccttgcctcaaaccaggcaacttgtgtctgcaggaaaaatgaccctttctttccaagtttctaatagctgcagacattatgtgggtacccacactcccactttcctacaaatcattgacatgttgaggttttttgtgtcttattataaaacaacttataccatgcttgtacagttctaagatgtgagatgaaccatctatttaataacagattttcaagggtaaaaccctgcatgaatcaatgtacttatgcatcttaagatctgtactctttcagaaatattaccatgtacaggagaaggtgcatcttagatgttcagcagtaattgctcctttttattcatcataagaaggcctactttgggccatcttataatcgtcgttatgagttgaattgtaccctccaaaatatacccttcaatatgctgaagtcctaatccccaatacctgtgaaggtgacctcactggtaatagggactttgcagctgtaataaagttaaaatgaggtcattggagtgagcccttaatccaatatgactaatgtccttgtaagaaaagagaaaatgaaacacagacccagagagaagacagccatgtgaaactgaaggcagagactggagtgatgctgccacaagccaaggaacacctggggctaccagaagctggaataggcaaggaaagatcttcgcctagagccttcagagggagcacaaccctgccaacaccttgatattaggcactgaacctccagaactgagagagaattaattggtactgttttataccgcacactttgtggtataacacttcggtatggcagtcccaggaaactagcgcaatcttacaccaatgctccgaagttgtgctatgttttggtttggctgtgtccccacccaaatctcatcttgaattgtagttccccatatccccacctgtcatgggagggacctagtgagagttaattgaatcatgggggcaggtaccgtcatgctgttcttgggatattgagtaaattctcacaagatctgatggttttataagaggccttttccctttttgctcagcttttcttcttgctgctgccatgtgaagaaggacatgtttgcttccccttctgccatgattataagtttcctgaggcctccccagccctgcagaactgtgagtcaattaaacctcttttctttataaattacccagtctccggtatttcttcatatcagcatgagaatggactaatacaccccgtttttcagatgaggaaactggcagatcactaggggtcaagcatagaaaaggtgcagccagaagaactaatcttttatagtctgtatgagtcagggttctctagagggacagaactaataggatagatatatgtatatatatttaaagatgagtttaagtattaactcacacaatcacagggtcccacaataggctgtctgcaagctgaggagcaaggagaccccattgaagctccaaaactgaagcacttggagaccgatgttcaagggcaggaagcatccagcacaagagaaagatgtaggctgggaggctatgccagtctagtcttttcacgtttttctgcctggtttatattctagccatgctggtagctgattagatggttctcacccagattaagggtgggtctgcctttcctagcccactgactcaaatgttaatctcctttggcaacaccttcacagacacacccaggatcaatactttgcatccttcaattcaatcaagttgacactcagtattaaccatcacagagtcttacccaaaccactcggaggtggcttccagttcattatgggggcataagtgtgtcctcagagacataattcctcttctggctgctttctgggaggaaatgtagaaaaggaaattggaaatattattggcacaagagaggtttgcagttgacaagtaggtaaacccaggctgattcaaaccttgaaaatgattgtgtgagcaacgatagtttttttaaaaatatcaatagttttaggggtatagttggtttttgattacatggataaattctttagaggtgatttctgagattttggtgcatcacctgagcagggtatgttgtacccaatatgtagtctttcatccctcacccctgcccacccttccccctgagtgcccaaagtccattacatcattcttatgcctttgcatcctcttagcttagatctcacttataagtgagaacatacgatgtttggttttccattcatatgttacttcatttagaataacggcctcgagctccatccaagttgctgcaagggccattatttcattctgctttatggctgagtagtatttcatggtgtatatctaccacattttctttattcacttgttggttggcggacatttaggttggatccatatttttgcaactgtgtattgtgctgttataaacatgcgtgtgcatgtgtctttttcatataatgacttcttttcctctgggtagatacccagtagtgggtttgttggatcaaatggtagttatacttttagttctttaaggaatctccatactgttttctgtagttgtactagtttacattcccaccagcagtgtaaaagtgttccctttttaccacattcatgccaacatctatttttttttatttttaaattatggccattcttgcaggagtaaggtggtgtctcattgtggtttaaatttgcatttcctagacaattagtaagaatgttttttaaataatcatgtggagggccaacctgcaagtacaagctgtgacagaggtaatttggaatgtggctccagcattcctcaaaaccatgaacttgggaggccaggagaatgcagtgtggaaccttttctttggcattcagggtgtccagccagaggactctccctcacaaagctttggggtgttgggttgaatgcaaggagggtgggcctggaagatgtcttggaagccttcttcagggtcaacacccacagatccatatattgatcctggccccagttcagtgaccctgacttttgccccagccagggctagaacaagttataccatatctgcacagttccgagatgtgagatgaactacccacaacaacagattttcaggagaggaagaaatgtaccaatcaatgcccatgtagactctaagacaaatattggtacagaaacattaaaaacaataaatggaggcatttaaaacaaatatacatggataggaagattcagtattgtcaagatgtcagtttttcctaacttgatctatatatttaacaaaatcccaattaaaatccagcaatttattgtgttgatgtcaacaaagggaagggctggcaagagccaggcaggaggtcagctccttgccaagggggctggagttcagagtagggggttagccatggctggtggaacagggaggtttcccagggaagtgagaccatgtctgtgaggcctcccacccgcccctcagggggcaggctcaggacatctggaaaccctcaagacctatccacggatgggcacagggaggctcctatctgctccgccctgacatggtcaagattggctctgtcctgtgtgatgtgtgcccacactagaggctgctgtggaggatgctggaccctgtaaatgcctccaggggaggctgtgggggtgtgtggaacatcctagctgctccagccctgcagtccttaggaaacacagggtgagcactctccacacaccttggctctaagaagggacatgcagtatccctgtttccagcagtgtccttccttccattctggagtgccacacaggcatctgtgtctggccattcccaggagtacctggctcataacatggtccagcctcattctgctcccatgtccctctccccacagccagcccagggcagtacagctggatttggcaggtgctcctcctcactcatctcctggggtggctgttcctcagcatggaccccaaagccctctcacaccaagctcctttcgaaatcctaatgtgggtctaagtgtattctgggaactgaggagtgttgcgatgttcaccgcccccaccatctgctacagcctttagtcttctttaactgcctctctgggcatactgaggccctagctgcctctgctaggacaccccagccccacctctctggatcaacctcagaaagcaaaacctcattgtcgcccatttaaggtaatcagttaatcaaaagccaggcattacatgggggattatttgaatagtacctcctaatcatagtaatttgtcactcatcacactgcaatgattattatttaccaaccactaggagactcgccaaaaacttcatcatctcctgccagttctaccacaatatcttggaaggggattccttactggggaatttcaaatgatgatatttgcgtgttaacataatcatcagatcctgtcttgggcccagtggttgttagtagagataagaacggtaaagctgtaaacagggccaactgaggccaagtattggggactatgggcaaatttgggcacagcaacgagagaaggaaacccctggtctcaactgagattttggctattttggccactgccttccacccatactgaggaggacaacaccactttcggaagcctgaaggttgcaggtcacatgaaaaacttcctgtagtcagcatcctatggggtgattcctacccagggccttaaatgcacagaatctggtttctcacatctaaaggagcaaatgtgtatgacaactcctaggtgtagagtgatctgtgttctgtgttgttatggtttgagaattaatgtattgcttctgcagcaccttcaatagaaatgactgtgacaaaataatgtgtctgcttctatttcagtggcaaagagtaatcacatgacccttcctaacttcaaaaggactgtgatgttcccctgtgttcaggaaggaaaggaggacaagacatagatgagcacttgtagtatctcccataaactgttttgcagatgtccaacataaagcaactacaattaatccttgaacaacatgggagttaggggcactgaccctccatgcagtcaaaaatccacctataacttttgcctcccccaaaacttaactaataagctattgtcgactggaagccttattgatgatgtaaacagttgattaacagatatttttgtgtattatgtgtataatatgctgtattctaacaataaactataaaaaaaattaagaaaatcataaggaggagaaaatatatttactattcattaagtggaagtaaatcatcatgaagatatgcgtcattatcatcttcacattgagtaggctgaggaaaaggaagaggaggggttagtcttgctgtctcagggctggcagaggaggaagaggtaggaggggaagcaggagaggcaggcatactcagtgtaattgaatgaaaatacgttgtaattttctttttcttatatctaaaagtttctatatggtaccaatccttcttccactgtttgttttagtttcagtgcccacatcatagaagggtccatgtcgtaaaaggagtcaaaagcagtcttaaaaaattggaactcttctgccagattgtctagtgttagttttttttcctggcaccgtttcttatacatctttttcctcatgatctgtcactggtttggaaacactcatctccatcaagtcaccttctgttatttcctctggcatggtgtctattagctcttgaattttttcaagattcatatcttgaaatcttttacattccatcttttggaccatatccacaacctctttcattgtttccttatttgtctctgtcgtaaatcctgtgaagtcatgcacaacatctggacataattttctccagcagaaatttattgtttaaagtttgatggctttcacagattttctataacaataatggcaccttcaatggtaaaatccttccagactttcataattttctctctatggggtttctcttccatagcgttgacaatcctttccatagagtaccatgtgtagtgagccttagaagtccttatcctgatttagaggctgaattagagaccttgtgtttggggataacttcgatcatttcagcaccctcaatgttgaactcattgggttctgggtggccagggacattgtctaatagcaaaagaactttaaaaggcagtcacttactgccaaggtacctcctgtctccagggacaaagcatcgatagaaccaatccagaataagtgttctaattgtccaggctttcttgttgtacaacccaaagactagaagctgatattttatctttccctttcaaggtttgagggttagcagctttatagataaggacagtcctgatcacaaacttgactgcatttgcataaaacaatagagttagcctattgctttgtgccttaaatcctggtgcttccttctcttcctcactaattaatgtcctttgtggcatttttcccccggagtagggtattttcatctgcattaaaaacctgtacaggcagatatgttttcttctcaataattttcttaatgacgtctgggaacttgtctgctacctcttggttagtagaagctgcttttcctgttatcttgacatttttcaagccaaatctctttctaagattatcaaaccactgcctctatcccagtgggtatatatatatggatatatatatatatatatatatatatatatatatacctgtgctttgcccaaacttgcccatactccccaatatctggcctcagttggcccagtttatatataatgtgtatacatatatatatttcattttattatgtatatatttaaatatatatgtatatacataataaaattattgaaccatcctttgctggcattatattctccagctttatattctacacggatcttttgcgttaagttatcatataataacttggatttttctggattcatattagaatctataggtatgcctttcttgtggcaattctgcaccacataaaggctgcatttgccatatgggataaaaaggtgtttcacaaaatgtgcaaggttttcacacctgctgatgtagttgcagaaacagcttcatgaatttctttttctttttcttttttcttttgtttttacaatggttcttatgcagatttcattaatcttgaaacagtgggcaactacagctgcaaatccaatctacggtacatgttaagcaattcaacttttcttataatgttatttcttttctctgcttcttggcaggaattccagcatcactagtggcacattgtatagatccaatggtgttattcaagttttaaagtattggactaaacatgatggaaaatacgtgagaaccatgagagatcactttttactgctatacgcaatttactggagagacaaactcctcacatggagataattagcgtcccatggcttttcaagcagatagaagaacacttgagcttactgcaatagcaacaggaggtggctatgaaattattacagtagcacagcttatgctacagttaattttatgcagttatgatttaatactacatctcaacatttgtttacatttatcttgactgtgaataataccatgtacggtctgtaactttttgtgtacataaattttgataaaaccttttacaatagacttcatatattttatagtactaaataacaaaatatcctagtatccacatatattttattcattcatgacataactctttttttatatctctaggctatgcagtttgtgagttttttcaaattgttgcaaactccaaaaaaatttccaatatatttatttaaaaagtctgtgtataagtgaacccacatagttcaaacccatgttgttcaaaggtcaactgtattataatttattactacagcaatcctcttcatttctgggaggaatttctgaaaaggtcagatttgcttcaaaattccccagctttttcaagtacctacttattatatgacagatgcttcaaatacaggatcacatctacttttcaaataattctagaaatctcatcagggaaggttcaccttcttcactcaatggcacatttctgcacttccctttgcaataacctctaatctcagtaggttgagatttttaccctatttgattcatggtcaaaattttaacttgtgagtctttgttactgtccacataactgaacttacctgaagacttgtgcaagtgccattaggcactttgcaaacaaggattttcctgtggagaggcacacagacaagagatagcagaaatatagtttttttttttctttttaaatcagagctagcatgtccaaagaggaagcgtttttcacctccttggagggctccagggtttttagaaattctgcttcagtagatttttttttcctacagtggtttacatggtctttctgcatctacaagctttgatgtttgaccacctaggtaagcttattaacctgtgtgtattcagtggaaagtctaataagacattttattaaaatcctactcctatatctagatgctttcaaaaaccctttatctaactttacatttcagtaacaagaaggaatacgttgtgtgccaaatcagagcctgcacccatttggaaaagtttcagagtgtattttgactctcaggcatataaccaggcatctgaacatcactgtccaagtgaacttttatgtcaaagaggctgttgccattagaggagttccagggtgagcaatgtgacagccaaaggacgttttcaggaagcaggcatgctctatgtcagggggaaggcaggtgattctgggccattccactgggagcaaggcacagttttcagatgatcattttcacatgcttactttaggtcagcttttagtgccttgacctcagcattcttctttttgtcaccttagagacattctgcaatacttactacaaaaatgaattacaagtcagaagatagacctcaagctggggagaatgggaatagcgtggtctctagatgaatcaggccagggatctggtgccaatctgtcacttactaactatgtgatcctgggaaattactaagcccagtgagcctcagtttctttatctgtaacatgtgtttggtactttttataatagactattagaatataagacatttattaaaacacttggcacagtgcctgacatacattgcatctttaataactatcatttatttcttttttttttttgagacagagtttcactcttgttgcccaggctggagtgcaatggcatgatctcggctcaccgcaacctccgcctcccaggttcaagcaattctcctgcctcagcctcccgagtagctgggattacaggcatgcaccaccacgcctggctaattttgtatttttagtagagacagggtttctccatgttgaggctggtctcgaactcctgacctcaggtgatccacccacctcagcctcccaaagtgctgggattacaggtgtgagccaccgtgcccagcccaactatcatttatttctaacattattttgaccccagattttggaaaatatttttgttttccaggacatctcagagaatttgcagttgaatgggaaacagaattatcactaaaaaatgctgcttagtaaatgtcccttgaagaggattcattatttaattaggtgttggggagtcttccatagctgagtgcaactcactaactttaagatcctagaatttgggtcacaaactcctttcttccctcccagcttctgtttcaaccaaaccactatttttcattcacctcattcatatcatccccaccaaaagtatagccatttcagtggagtcagctgtacaccaaaccaggcagaagagtacctggccagtggcttctggcctcccttcctgagagattcatgcttatctcaggaaattcttgcagatggcagatgttgggtatcagtcagccacctcttacactgtgttcgactacactgggacaaaagtgcaggacaccttccattcctgcccctggtggagactcctctctgctacatccaccacccaaaaggaacttctcagagcagtttttcattccaggcttttctctaaccctctaagactcatggtctgagattgtggcgcttgtcagcttcattataatcaactcctcaagaaggaactgcggtttcccaaagatcaaaacgcccagctcagggcatttaacttcaccactctcacctggagccccacaccctcacccctctcttacttttcctctgcatcttagaggacatctcgccaccttaattacatgaatgcaactcctagactctactactctaagggtaggggtttctctggcttattctagtaactccactactaacccagagccttccaaagaggagatgctcataaaagttgtggaaagaaagactcagtgagcaggtcttttgtttaagttgtaatttctcctacaaccttcaaaaagcgaagcaaatccagttatatgtatatgtttcaatttttatagaacaacagatgaaaatggataaaaaggctagaattagcagacttttccttttattttatggccccatcaatcttattgataatttcttacatttgccaagaaaatatctattccaatgccatggtatattgttataagtcacaaagcaatatggaaggtttcccagtatgtctcactgaaggcagcagtggccagtctggagtggatgctaccatcatatgaactacaacagggaggtgcagccagggctgcacactccttggaaccagcatgaggcagggacaagtgggagccctgccccttccgagttggtggggtgggagctccccgggtgcagccacagccacccaagtcgcagctttggatacaggcctcccgcttcatggagcagacaggagcctcactcccctgggtgcagctgcagctacccaagtcgcagctttggatacaggcctcccgcttcatggagcagacaggagcctcactcccctgggtgcagctgcagccacccaaaccatcgctgcagacccaggcatcctgctgcatggagcaggcagaagccccgcccccctcccctgggcacagctgcaaccgcccaaaccatcactgcagattctggcatacctgccctcttgggggcccaggaaggcccccaccaccctggcagggtcagaaatgcctgctcctactcctggcttctccctgctatcagcaaccactccagactcagagcaaagttgggccaagcccaggtgctgccacagcctggctgggtgtgcacacactcagggcagtgctgacatgtcagtcccctgctggcttggacccctacggaatttgggcgccaatgagcatagtagggaagctgatggggtggtgagggcagctcataactggcctgtaggcatcccttggcacctatggcctgggctctgtgaatgacagcaggaggcagacaggttcctggtcagaaggcggcgagtccctggtgaggccccaccttcaggccggggagggcctgaagtctgggggctgggctgccagtcctgtggaccagagtgggaacttgtggtgccttttctgggcccacccatggccaccgatggaccaattggcatgcactttctcccttctgaggcccaaaaatccccaggctcagccagaagtgagcagatgtcgggacaaccagcttcagagaggagctatccactccagggcctcccctctgctggaagctgcagagatgggaggacctgcctgcagagagaagcttcccactccagggtctcctctctgctaggagctgaacacttgttgggacaccctgcctgcaggaaggagctgaccccctgcaggagactaagctgttctattgctaattaaagctcctcttcatcttgctcaccctccatttgtctgtgtacctcattcttcctggtcacaggacaagaacttggaacccattgaatagctgagctaatagagctgtaacacaaacagactgaaatatgccccttgctcaccatgttgcgagcaaagagaaggagataagacctgtggcccatccgggagcccagacctgggagctccctgagccagggctgtgactccctctttggggccttgcagttcctggcatctccaagcttctaggtgccaccatgttctgcagtgccagctgtggaagctgcttgtggtgtgcctggtccagctgcaggtttgtggagagccaacacctgtgccagtgcctagagctgcctgccccactgcagcagctggcatgtcggactgtgtgcagtggctggaccccacagtcattcacacaaccctcaccattccacgcctgactcgcccttggcgggaattggacacagactggtagtgcgagctgagtgcagcatgccagattgaatggtcaaaacaagcccaacaggcccaagcaaaattcaggcaaaggtgccagtggccacagaggtttcttgccagaaaaatgacaccccaaaggtcccataacattacaaaataacaaactcttatacatgaaatggattagtaaaaatacatgtgtgattaatatcattcataaacttagatgttaaaactaattaaatcttctgttaaaaggaacaaatttgaaaattactaaaaggaaacaaagataaatctccaatcactcaatagaacaggaagccaaagatggtatgcaatgtgtttccttccacccaccttgacctcccttaccaagaactctgactactctgttcaaatacagggtgaagaaagggcctgatttcacatggggtaggttgtgcccctggaacttgcactggccctgtccctaaacctgccacctggtggccctggctgcaacttgtactcatactccctcttccccctctcttaaagcctcttcttacagagacgggtaggaggtgggatctgtcccatggaccttggccacatactccaggactttcatcttgttggttttagtgtgggctcttggactctacaggaactcatagtgtgcaggatcactgctgggcacctggtggtactccaggtagttttcctgcacccagtcttgggtgagcagcttcctgggcttcccatagacactgtgcttcttcccagcatacagccccatcacactcagggtttcccatatgacctcttcaggggtgcagttgccctccattataatcgtgcacaggaccattatctggaggcctgcattgggcttgctctgatcatcacccagcaggccgtcataggagaggcccagggaagtgacaaggatgtaggagtggccagtggtatccacttccttcatgtcaaaaaaaaaaaagaccagccacatgcacttgaagatcacaggaaagtaatccttataatttttgatgacactctctagcatttctgcctttgtgtttgtctccttgactcaatacttgtagagcaggaaatgaaccaactcagtcaccttcccatcaagtgcttcttggaacaaggtcttcaggtctgctgggtctggtgaggtgcctggagcctcctcttggctgctggagccctcattagattggctccatagagtgttgtcaatggtagtgggggaggtagaggttccctgaggactctggggagaaccaggtgacccagcagcaggcagcccctccagggtgcccactgtcagaggagaggagaaggaggcagcctcctgttcctcagccaagggagcctgcacacccaccaggcccaaagcctcgtctccttcggcctcaaggctttcctcaggctcgcagtgctgattcctctgctcaggagacatgatgactctggtcagaatggcagagtgtgggcaggagctgggcaagtgggacccacaggcctgaggagagagggagccagtgagggacctcagctgagagccgaaccttggaggctctaacaaaagcagacttatggatcttttcatttggtgctcctctggggcctcctggggcacctatcctcctagctggcctgttcaccgagaacttggaggaagtgagagtgttacagtgggtagctagtcaggtatgaatagggaaggagagggttcccccagccccttcactcatgtgcacatgcatgcgtgcgtgcacacacacacactaggaatgttgggtgaccattaggcgatggtcaagtggttgttaactatttctgtaaagtaataattgttcacagcccttgccaggggaaggcagtctcctaatagaaaacacctgaaatggatcagcagcttcccaacaagatctcaggactggggagaaagtaacacaagatctctgaagtaggctgatatggtttggctgtgtccccacccaaatctcatcttgaattcccacgcattgtgggagggacccagtgggaggtaactgaatcatagaggcaggtccttcccatgctgttctcatgatagtaagtctcatgagatctgatggttattataaaggggagttttcctgcaaaagcttttttttttttttttttgcttgctgccatccatgtaagatgtgactttctcctccttgccttctgccatgattgtgaggcttccccagccacacggaactgtaagtccagttaaacgtctttctattgtaaattgcccggtcttgggtatgtctttatcagcaatgtgaaaactaatacatatgccaacataaaaccccaagtcaagaggtcaagctgtgactttggtttctcaagttgactacttggccctcttccgagttatacttttcttgtttcctttccttcctttccttactgttctaaagctttgtgttttgtttgtttgtttgtttgttttttgcctcagtctttccttctgcctttggcccctcagtcgaattctttcttctgaggaggtaagaactgaaattgccgcagacctatatggatacaccaccagtaactcagggtaacttgggtacctgccaccactaacaagagggctcctcagggtgcagcttgtcagcagaagccacggctccagcaataacagtaggacaggtgggttggcactttggagtcccctctgctctggggccggtggagccctttgtatacatttaaagtaaacacctcaccttgcctgctggcaatacctgggcctcctctgctgtatgacttcaggacactgcctcagaccaaggcccaaacctctctgagacctgggagaaagaagtgagggggcaccacacggaaaattctgcacgggattcccaaggctgacagaaggagcaggtttcaggggtgcctcctctgtctgcgttcctccaggtattcagatttattcccgacagggcccagccctttcgctcctgctcaactgtggatgagtcttgtgtgccaaggccaccatcttcctgggacccccaaggagaaagtgggggaccatgtcccttctccacaggcctgccttgggcctcccaggactgatagcagaggcagatttcctaggtccaggataacaggtctgctgagtcctctctcagggctctaggggacttctctctttgctggcctgaggccctactcctcatattacacccctctcgtcactggcaccccaaagacacagcaaagatgtgccacacacagccagcactcccaggacctcccagggtcgaggtcctctgagtcctccctcttcttcctcctcttgatcctgtcagggctgagcctcacccctttgtggacctgaatctatatccctcaaattcccaaggccaattgagaaggtgcctcagtctcagaaagaagtggagtaggccccctgttctgggttgctgggtcccctcaggcctgccttgtctcccagcctggcctggacccaccttctgctcccctgaggccgtgctcatgattccaagccccttccctccatcagcccccgatgtgaacatcaggatccacatgcctgtccaccatgcccggaacttcccagggctgacagcagagatggagcctcgctctgtgggatctcagccctccttcagggtctggaccatgatgcctggcaggcagagcatgggtcctgccctttcctaatcagcctttccctggtcacaccaagctctgtctccagaatgccctgcggcttaagtggcagtggagccgggagcggcccagcctgagaagtctgcccccaggtggcccagggctggcagcaggggtggcactgggttaattggggtcctctctctggggtaggggcatcctcagtcttcctcagtgtctcaccttgcctcctcacagagccggggcctgtttcactccaccaatctcaagctgccactcagagcgaggcgctcttgctatcctctgacccctgaggccacgtcagtggcgtgacatccggcccccaagcctggggcttccctgggtcgacagcagcagcggaactggattcttccaggcatgggggtaggaatggttataggggccctcaagcttcccttagggtcctgacattgattccttgcagagcctggacaccctgccctctgccaattgggtctgctcccttcacaccaagtctctgactcccagtcccctgaggtggcagtggtgggaggcgtgtgttcagggcgacaacattgccaggatcttccaggattgttagaaggggctgagctggattctctggttcctctacaaggggagggtggactctcagtcctcactcaagaggatcctcctcctggctcttggatctttgatgaagccatgggcaggagatactctgtttctgccacttctgagcatttgcccagctgcatctcttgcagagaatggctgcgggtcccaggccaggtactccctgcagagcggcagcttctgtgattgtagtgacctctgggagaagacacacaccttcccaaggaagctcttccccagccacaggtcgagtttgcaaacctgttttcctaaaatatttgtttttacattaaataggctgagcagcagcatgaaatttggggattcctgccattagaattatcgagtatttcatagctcagtgcagtgattttcatttttaaactttcattcagcatcagaaatcatacttaacctcattatgcctgtttcattctaatgctcaacactctatttgtaatccattctttatgttcagttaagccaattcacctattaatgtggttttaggtggttattagcacagactggagctactactgtttcaatgaaaccagactactggcacctgtggtctcaggtgccacctgacattttcacactggaataggggcaaaaatttaaacatttccttctacacatcctgtcatcttccttctatgccagctatggactctccctaacttccttgacactctggccatttcgattacaggtaccagttaaacacagtcttcattctcccccagggctttgctttgttgtttagattttgttgttgatactatttgtttttttattttattttattctttcttctatagttttccaggattgattttggtagttgagggcagaagtccaagcctgacattcatcttggcagctaaattttaagcattatatctgtaaatcttgaataagaaaaattgatatcttttcaatagtctgttccctattaagggatatagaatacggctctgtttatctgggaactttttgacctaactctatcagtacttgcatagttgtttccataaagatcttgtatgctttgtctgtctccattggataatttctagattttgttgccattgtgaatggggtattttctattacttgttctgaatagttatttatttgggttgcaaggattttgattttactgtagtaatcttctgtatactatttttctgaagtctgttatttgactattccatctgcacaattctttgaattttctagataatcatattgtcgtaccaaatattaaatctgttcaatatttatactgattttttttttatatccacctctctggccttatgttacagtgtaatttccaaagatagaggttatagcatagtcctatgacaataattcttctgacatttcatatttgggtatgctggccagtgatcgtaggaaaagctaatttccttctaacctcatttggctaaaacttttgaccatgacctcttgtagaatttcctccagaatcttttctgtacctattatacctattaaagtgatcactttttaaaatcttaattcgataacgtaggaaatcacaactgaaaattgttttatattaaatcatgtttttgttccttggacacaatccgttaattcacttctatgttgaatatgctactaatttaattaatatatttgcctctgtgtgagtgaagtttggctcaagtgttttcacggtgctgtcctcctctggtacctgaatgaagaatggttagcttgggaaaataatttgaataattgcccaacttttcgtatgccttggaagagtttacttaaggtggctttgagctttacctgataacaatgtagaattggcctccgaagctgccttgtccacatttgaggatggcttgagcttagattagtttcactttttattgtttggttaaagatttgaatttctttttgtatcaatttgttcatgtacttattttcctaaaatattatccatttcacttaggatttcaaattaaatatcatatttatttcaaaaatattttcattacaagcattttcaaatacacctaataatagggtaaatactataattaatctaatataccagactttcagtatcaataatcttcaactcatggccaatctggttctagttatacccctacctactccgcatagcagaaactgaaataatgtggagcaaatccaagacaccatgtgatctcatctccaaatacatcagagtgcatttctaaagataactactctcttataaaacataaagccaacattattatctttcctaaacatgtaagcaagtcattaatataatgaaatgttcacttatttgtcacatgtatctggtggacatatgctcctgttaaaatgcagtttctttgaatcggtttgcaaatatgatctatacattgtgtttatgttcttaatagccaccttaagtaatttatagattcccccacattacctttttttgaaactcatttgttgaaaatgaagacatgccttgtgttctgtccagtttcccatactctggattttgctgagcgcaatacttctcttcctgcattacctatctgtttttccatgttgcctactttttccattaaagcctcttaaatttttaaaaatagtcattttaaattatctgcctcctaattccaatatctgagtcatattagagtccagttctgttgattgtcttgtctcttcagactatgtattttcttactcttttgcgtgtgtcccttgcaatccttttgttgagagtgaacgtgttgtatgagatcataggaacagaggcaattagatctctacagtgaggatgtatgtcaatttggctgggagttgggctttatttcttatacctatagatgccagaggcttcagattcctctagtgtccttgtttttgtcttccgttttattaattgtggcaaatgtgtaatgctaatataagaggatggtaatagggaaaactgggtgtggggtatatgagaattctctgtactatctctgcaataattctgtaagcctaaacattttctaaaataaaaagtcattaataaagaatgacttgttggaccccattggaaggaacaagaataaccacccctcacattgagaattggctctgcaagagagagaataaaacatttatcctgcatttcctgtactaactgtatttcaggatgacacaatagctacagttgatgaggaaagtttcttccttactggagaattccagctgaggaaaatgcaacatatgagagaaaaggaaaacaagtatttgcaatatccagcaatgcaactgatgcaatccatgctaatcaatggatgaaacattgttgaagggttgatgacgcactctgcaatggaggaacaaggctgtctccacctctccacctgagcccactgatcagagccaatatgatcaagggttgaacagccagaagttgtatgcctcctgctggagtacagtaggaagcacaaagagcctcctatgtgtaccttcccccccaacaaaaagccaaacctgcttctggcctccacctgaggtgaactttgaaagataggaaatccagtcctggattaagacatctggcccctcattgaagacacagagtctactctggaatgagcactaggtgtcaccagacagccttctgctttgttctgcacccagtctttacacgtgcaccattgtcctgcccgccgcagcagtgccacagcagcaggccaacagccttgcctgttcaatgccaatggtgccttccatcccctttatcccgagagaaaggtttctggacacctagacctgtattctgtacccagtcctcaggtcaagtcagtaacctggaatagaaacctggatccaagaagccagttcatggtacagtgcagctgacctggctctgaggcagtccatggctcagaggatcagggaataccctttacctggctcaccagaccagtgtctctagaccctgccctctacactctgttccaaggccccgagcgactgcatgtctttgttctcttctagacgattgctcttataatactgttagcattccttcccagacatcctcggttctctctcgagatatctcttctgtgaggccttctatgaataccattgtaaaaattgcaatccctccttccacccaatttccagcactccttatttagctctctcgattcaatttgtttccatagcgtttgtcaccataaaacctacttcacctgtaactttgttccgcagttcattgtgtgcctgcccctcccctcccgctagaacataagctccacagaagcagggaatttgttcaatgctgtatcctcagagcttagagcagtgcctggcaaacagtacatgctcagtactcagctgtgggacgcatgaagaactacagctccatggtcctagtattcgcagcctctgcattggagcctcgtggcattttcagtcctcccaattacccagcaatcaaagtttaaatgcatcccagcaccctcttattgttgagtcatggaacaggtaagcaactgagctctagggactccagagacctgctgccccagcgcctggtctgtgctcctggcatcctggggaagtcagcaaggcagggctacaaacatcagtggctatctgagcactctctcttgccagtaggcagctgtggcccttgtcccaattccctgctcctctctctggtcgtttgggtctgcaagcagccaatgtcaaggtctcacatgtctctgggtttcagctgggccttaaagggatttatgtaacattcagttcaagtaacactttcccattgattcctggacaagctctagacagaagtcccatgttcgccaatgactttgatgctacttccctggagaaagtaggaagggtggccaacgtggtttgcaaggttgcattcatctggagaatgctccatcatgatttctccccaatgccagtagacaggtgccatccctgcctttgtacacaccgttccttgctgcgtgaagttatttgaggaatcattacacactctccaagaggtaacataacatgatttcattcgctcattcattcaatatttatccagctcctcatatgctccaggcactgacctaagtgctggagatactgtattcactataaaaagggcttcccacctccgtggtgttcttcctaataatgcataatcatgcatgcccttctaatcgtgagaagacattagacccactgaaactgagggatgttctacaaaaatcagactagtattcctagagtcctccaagacagatttgatgccaagatggggaagaaggaagagtatgttggaggcctaggtccttgcagacatgttctggagatacacactggggtttgggagcacagcaggagggactgtggagtgggcagaaccctccagggagaggtcaggggagcagtgcaggagtttgaggctgcacaagaatgacatgacctccatgggaagagcacactactcaccctccttctgagatgaagcattctcttccccttcctttagccatgtgacaggatctggtcaggtgaggagaggagtgacacagatggggaactggcaccaggtcctcaggggatggcaggcaagaagctggggctcatgaagctatgtgaggcagattccatagaaggagactcgggagctttgggtttcattctcacatcctgagaacacatccagagacttaagtcatacacatttgctcccttctatgcgagatgccagattctgtactttgaaggccctgggcagggatggaggtcttcacaggaagcaacaccccgtaggaagctgactgcaggaattcctgcattgccatctgcaccctttgggccctgaagcatgacccatcagtattttaagagccacgatgtgtccttgaattggaggctggcagccagcagtcaaatgcccttgttgggattgcaagtttccttctcctggggcccatagttgtgttctcatgtcccctgctgctgtgtccacactgccccaatcgggcctcagtctgcccagcttggggctttgcgcttcctctctccccactaactgctgctcaagacctggagctgatgctcatatgcgattatcattgtgataaattccctggtaaggatctccttccaaggtcttgtggtgacagaactggcaggagatgatgaagccttttggggaggctcctagtgaataataagcattctgacatgatgagtgacaaatcacgatgattaggagatattattcaaataattccccaggtaatgtctggcttttgattaaccgatcaccttaaatgggtgactatgaggttttgctttctcaggctgatgatccagagaggtggggctggggtgtcctagcagaggcagctagggcctcggtatccccagacaggcagctaaagaagactaaaggctgtagcagatggtgggggcgttgagtatcgggacactccgcagtccgcagaatactcccagatccacgttaggacttggaaagcagctgggtgtgagagggctttggggtcctgagggattaggctgtgctgagcatcagccaccccaggaggggcgtgaggagaagcacctgccaggtccagctgtactgccctgggccggctgtggggagagggacatgggagcagaaggaggctgaggtgagctggaaccctggaccaggtcattaggtgggtgctcccaggaatggcctgggtcagacccctgtgggcgctccaggatggaacaggacattaccggaaacagcgacatcacatgtcccttcttggagggagccagtgggtgtggagagtggtgccctaggcagttaaggacatcccaggtacctccccatctcccacatgcacggccttttcaggagtcatttccaggatccaacatcctcacccgtatccttacatgctgacataccagggcccaagcctgttgcatgtgttggaagccagataaagttgatccaagaagattatttgatttttcaataaaccattatttaataaatatatcatgatctcccagtgggcgctaaggcttatcacgggcaccagtagttccaaacatggcattcaaaccttgctttgaggtgctcacgatctaataggggtatgtggctgggttagtagattctttctgcatggtttcagaagagccaaggtgtgtgtaggacacaaatgtacaattagaaacatgtttgtttccaagtgagaatagtttagccggacttaggtttaagggacacagctggaagcaggggctctggacccagccagcctggatatgagtcttggcgctgccacttcctagttgtgtgatcatgggcgagcttccaaactccttgtatctcagttccctcatctgtcaaacatgaatagcagtagcatgtacttcacgaagcacatataaggactgcatcaggtaatatctgtcaagcacataaacaatgcctggtacatagcaagtgtcatgggagtgtttattaaatcagcaactcctgacctcagtagtcactggtgtgtgtgcggcttcaggatccagtaagacagctcgtggaaggttggtaaaatatggccgaaacttgtcctccacggggctgtgaggaacttgaagcacttatcccactgcctggcacagtaaatgatctgtcaactgtgtacagttatcctcgtccttaaggcttcccctgatcctcgggtgctccagagggtgctgttgcatctgtcaaatgttcttactttctgcagcctcctagtgtccagtcctggtgaagccccttcacatcctgaatggcttctgccatcattgtgcagtgctgggcagcccggggtgggtcacaggcattttttcagtggagctctcaaataacaggtgttttgatttcaaagctcagttcttatccaccacactggcttactgtgggatgcagaactattgctgtgacagcaataatagcatcctctcactagtactttacagtttattcagtgggccacagaggttatctcatttgctgaaacaagtaacaggacacagtaggcttgagattctggcttttgattgagcccaagtcaaattcctgaggagtctatttttagagttcccgacagcggacagggatggcccctgcccatggcttaagcctccaatagtggtgatatctcagggtctaacttccacttcattctgctgtcatttcggagcacagtagttacagtaatttttgaaaacagaaagcaaccaggatagccttgaagaagtaaccccatacgaagcagggggatgggggcttcgtactcctcccattgattccttgactagtcactagaaggaagctgaccccggaaaggaagtttcctacaactgagggccgtccatggagaggaccctggttatcggtcatcaacaaacaatacctttgggggaatgagcgcctcagttataaagcaaagatcttggtagcactataccatccactacagtccatcttctcttgcaacagttaaacctacatttttttctattttttttatttataatgttttgcggtacatagtagctgcatatatacttatggggcacatgggatattttgagacaggcatgcaatgcataatcacatcagggtaaatggaatatccatcacctcaagcatttatcctttcttcgtgttacacacatttcaattatactcttttttgttattaaaatgtacaataaattatggttgattgtagtcaccctgttgtatgatcaaatattagattcattcaatctaactatatttttgtactcattaaacatccttccccccccccccactccactacccttctcagactctgttaaccatccttctactctgtctctatgagttcaattgttgccatttttggctcccacaaatcagtgagaatatgcaaagtttgtctttctgtgcctggcttattccacttaacataatgccctccagttccaccttgttgttgtgaatgacaggatctcattctttattattgctgaatagtactccattgcgtatatgtatcacattttcttattccattcatctgtggatggatgcttaggttgtttccaaatcttgggttttgtgaccagtgctgcaacaaatatgggagtgcagatatctcttcgatatcctgatttcctttcttttgggtatatgccaagcagtggattaaccctactttttcatgtagaaagttcacctcatttgagcacaactcctcaaggattctggtgatctcttactgaagaagttcacatgagaaagaagagtgtacaaacgataggccctctgtggcagctggcctctaagccacaactgatgataattctgttccttgtctactatccattctagagtactgtcggtttcaaccagaatctttgctgttctctattacttacccaatagagtagtgcaaaccctcatcccggaaggttctgggctcctggtcctccacgaccttctcaggctgtggcacttacaattgtccctatactatagaaatctggcaggggactacgaagacacattcaaggggtcactcgagagccaaacattcctctctgttcccattgtataagggcagccctacctcctcctgatgatcagagccaatatccctgcaagcatggcaactcctttttatgcttgctggtcctatagcatgagaagctcaaagtgcccagatgggagcaatagcttgaaatttaatggaaagagtcccattaaattgtttttttccaggtggaagtaatcttactttgggaaccaatatatctagccagcactgtccaatagggtaaccagcagccacatgtgaccattgagtatacaaacctggttagtgtgactgaggacctgaactttaaatttaattttaaatagtgtaaacttatgtgcaaatagctaaatgtggctagtgacaccttattggaaagcacagttctagaactacagaacctaaactcatgtagcagaaagtacaaattcccatacaggtcacagggagtgacagtaagtgaggtcattccaccctttggtatctgcatcatgtattctatctattgatggaagagaatggtaatagatttagggtatatacagtacagtagagaatgacaccccatcctcaaggctgtgatctccaaatttgcacctcatttgcactgtgaagaagccactccattattccagtagaccagtggcttttgggtggcgcagtatgagataacaactttagatcatacggtcatgtgcccactgagcacttcctttgctatatgtgggtcccttggtcccagctgatcgtatggagtatcctggctcagtgtatccaacattctttaagccctgtgttagtggtgcccgacaaagaaatgtgagcaggaaagtcaaacttatacctgtaatgtgtacaaattccagtaaagatgaatctctgctccttccaggatggaatttgctggacgcaatcaacaagccacaaggggctgattagtctccttaagtaatggtgccctactgggtattcagcactggcctctgttgctggcagtttgaacatttggcaaaaatagctggatatgcctgggtgaatggggacccatgctgttgaacacatgcatagcatccacttcttccaccgtggctattgcacacataaggccattgtgtagcattaatgtggccagcgactgaggctggctaatgtcaactagttaggtcatttttttcttgattaaacgtttagtgtctcttccatggtgaatgctctcttgagccttaagacgtgatacaaatatcttcacatatagtgtcccttctcatacgtccatcaataaacctccgtccccaatcctgcttattgcaatctgtcactacttctcattctaagtccctgagcagctgtccaatttatttttcactgtccataagtccattcgtagtttgggtcacttcttttttagatatgaagtggatcatcagatgcaccatttgaagctctgccacctggggatttctgctcaacaatgtatttcttgaccacatacgattgaggtagtattacaacagaagttcattttcaggttgcgctctaaatccggccaaaccatctattatctaagctcagcacttctactcctccagcagctggtcataagagaacttcctggtccattaatctataggaataaaaaagagctgaaggagagacacagacacaacagtggcagatgacattggggattaggtcacctgcttgtaatctatggccgtgctggtatctggtcctggatatgctacttctatcttatcacagattacttttggaatcacctgactttgtgggtctgacagaacctagctcatgatgatcagtagcgacatgccatgtgcctgaggccgtggtgatctgttctagtgaagataacaaatctgttaaaggctcttgccattgagcttgcagtagtgcaaagttgcagtagtcccagtgacccatcaggttcttgtaggagccaggctgctaccttaaattaagatatgatggggatcaccacccctacatcctttaggtattaagggtgtcattaacattttccatccctcaggatgcaatattgtttattacttactatcatggccaaggtgcaggaagtgcacttggccttctctactctgctagctcttctactaacagccacggacccagtcagggtttgtgcccattatcgaggaagtccatttcaatttcccatttggaaactggataaatgggcactctgggtcagacctaggcaagaactccatttattcctggcccacatttgcttccactctaacaaacagggggccatgatgaagcttcaggtcctaggtgtcagtgtcaatgcagattctgtgtccagcggtccttgaaatgtttgagtgttttcccccttcccagtgttcagttactgaggtgaatagacataggttcctttggaaactgggcttggaaaaccactattgtatcaacttgccatagtattgcaggtggtttcctcaagaggactctaccattgtgttatgttcagttaataaattctgtgtctgagaattggctcaggtctggaaactgggagatggattaaaactttattggagcagtttacccagcctactgcttattgagcctcgatttcatgtgggtatataagttaagcaacatacttgttgtctgttcttctatcttggctctaaaagcactgtgttctgttaacagagtctgctcctctctgcagatgagattccctgtttgccactcaagtttcctgcttattatgatcattgtgaccatcttgcttttgaaatttaagtgccacttccgtagtcaaaggggcaggtggcccaaagcttccagtttggggtgaaattgcaagaaatagagactctgtagacagcatctgcatagcaccaactccagaattcactgaccacaggtgatgctgtgggccctgacctcccatggcttcccagggtctggactaggggagaaagtataaatttcaccagagcgctattcatgaacacacatgcggcagctccagaaattaaaacaaaacaaaacaaaacaaaacaaaaaaaacaactgagtcatgtttacaagaggatagagaccccgtgtcatgcaggagtgagtgcagtcagtgaactctgaattgttaatgttaacccaacttggaagaaagaaagtgcaattgattttattcattgacatgatcctgtatgcagaaaattctaacaaacccaccaaaaagtattagaactattcaatgagtttagcaagttcacaagatacaaggtcagtacaaaaattagtagcatttctatatactaacaatgaataaacccaaagtgaaattaagaaaataattgcattaagaataaaatacttaggaagaaatctaacaaaatgagtgcacagcttatacactaaaaactaaacaacattcttgagaggagtgcaagggaatctgaatgagagagatgcatgcactgtgttcatgagtcaggagatgcaatattgttaagatgtcagttctttccaaaatgatgtgtagattctacatgatacctataaaaattccagcagatctttgtgtcgaacttgactagctagttctagaatttatattaaagtgcaaaagacccagaatagccacacgcattttggaaaaaaaaaaaaaaaagctggagaacatttacttgccgattcaagatatagtaatcatgactgtatggttttggtataggagtagacatacagatcaatgtaacagaattaaaagtctataaataagcccacatatccttgtgatcaactgatttttaacaaaggtgctaacatattaattccacgggggaaggaatagtcttttcaacgaatggcactgggaaaattgaatatccacctgcaaaaatatgaatttgcacctttatagcagaccttagaaaaattaactcataggagaaaatcttcattaccttggcttaggcaaagttttattaacatcagcaaagcacacttttgaaaaaaaatcaacaaattgtacttcatcaaaatttaaaactttttttactggaaaagtcacaattaagaaaatgggccagatttggtggctcatgcctgcaatcccagcacttgggaggctgaggcagatcgcttgagcccaggaattcgagaccaacctgaggcacatggtgaagcctcctttttactaaaaatacaaaaattaacccagcattgtgacacgcgcctgtagtcccagctccttgggaggcagaggtgggaggatccattgaatctgggaggttgaggttgaggctgcagtgagccatgtttgcaccactgcactccagcctgagcaacagagcaagactctattaaaaaaaaaaaaaaaaaaaaggaaacatacgtccatacaaagacttgtacaggaatgttcatcgaagcatattcacagtaactgaaaagttacaacaatccaaatgtccatcaactagtagatggataagcaacatatgctgcatctttgcaatgctgttcaacagtaaaaaggaaagggctacaggtacatggtacagcatggattaaacaaataagccatgtgatataattccttttatatgaaatttccagtaaaggcaaatcattaaagatagaaagaaagtggattagttgttgccatggagtgggctgggcacgtgaattaactataagtgggcataggaatcttattgtgtgatggaaatgttctaaaactaggactgtggtgatggttgcatgacctagtaactctagtaaaaaatcattgatttgtacatttcaaatgggtgaattttgtggtttgtaaattatacatcaataaagtttgaaaaaacccaacaacctaagactgggcaaccttgaagactttaactctcaagtttgtccacactgagcctccagcagttcatcagttacagtttaagttttctgcaccattactggctccaaaagtgatttctgtttctgggcttctgcttcagtaagctgtgattctctgtatccacctgtctagctctccagttttgggggcactgctttgctctgtgaccttagttctccgatgaatctgagaagagttactgatttctgctttgctcagtttctgttcttgttgtgaggatgagagtgatgacttctaagctccttatatgccagaccagaaaccagaaatttccaataaaaagatattttcttgtttaattttgaaaggtgatattaagcctctgcctggcacaacctctctggtcctccacaagcttaggccaactcaggaccccggtgtagccagccctggagggcctccacaccctgaagcatgagggacatgcctggagccagcagctttacagaagagctctggggagcaggtttctgggtgggggttatagaagctgtggctcagcatctgcagctggaagctaacaaagtgatgcattcatttgagctattatcacagaatgggcttgtgtaccttgcagctgtcatcaaaaaccatcattcttccaacagtaacttgtccacaaaccgcatttcctctttgcctctggagctgcatgaactagtagtggactagatttttgcctggattctatctctacttgtgagcaagcgttttcctttagtggaaattcctttattcatagttgccaaaaattggaagcaaccaagaggtgctcaatacgtgaatgaattaataaacggtggtacttacagacaatgaaatgttatcaataaaaataagtcaggtcgggtacgatgagtcacacctggaatcccagcactttgggataccaaggtggaaggatcgtttgtggccaggaattcaagaccagcctgagcaatatactgagaccctgtctgtacaaaaatttaagaaaatagttgagcgtggtggtgtgtgcctgtagtcacagctactcaggaggctgaggcagaaggatttcttgagcccaggagttcaaggtttattatggacagtgagctgtgatggtaccactgcactccaacctgggtgacagagcaagacactgtctgtaaacaacaacgataaaaacaaacaaataaacaaacaaacaaaaaacccacggaggaacctagtgaagaagccggtctgagaggacaacatattgtgtgattccaactgcatgactttctagaaaaggcaagctggagagacagttacaaagatcagtggttaccagagttttggaggcagcaagggagggataaataggtgaagcacacatattcattgggtggtgaaactgtaatggtggatacacaatattatgcatttgtcaaaacccaaagatccttgcaacacaaagagtgaaccttcatgtaaactacggactttagttaaaaacaatgtatcaataatgatactagttcattaattgtgaaaaatgtagcatactagcagaggataataatagagaaaactttgtacaggggacaaaaggagtatatgggaaacgtactatctcctcaattttctaccagtccaaaatttttctaataataaagcctattcattaaaaaacaactagaactaaatatacaactaacaaacaacccagcaatcacacacctgggaatttattttagaaaactaacaacttatattcacacgaaatcctgtacaagaatgttcactgcagctttattaataagcaagtactggaaacagcccagatgtccctcaacagactaatggtttaaaagacaactgctggccgggtgcgatggctcgcacctgtaatcctagcactttgagaggccgaggcgggtggatgacctgaggtcaggagtttgagacctgcctggccaacatgacgaaaccccgtctctactaaaaatttaaaattagccaggcatggtggcgggtacctacaatcccagctatttgggaggctgaggcagaagaatcagttgaacccggcggggagcggagattgcaatgagctgagatcacgccacttcactccagcctgggtgaaagagcgaaactccatctcgaacaaacaaacaaacaaaacctgtggttcatccaggtcccttggaatactactcagcaatgaaaagaaatagactgttcatacacacaataagctggatgaatcgccagacagtcatgccagatttttaaaaagccagtaccaaaagcttacataattgtatgactgcattcaaataacattcttgaaatgataaagtgataaaaatacagaacagatgagtggtgtttctaggggttgaggaggagaaggtggtgtaggaagaaagtggctgtggctataaaagggcaacatgagggacccttgtggtgactgttctatgtcttgactgtatcaagttaatatcctaattgtgatactgtactacacttttgcaagatgttatcattagaggaaggtacataaagggtgcacagggtctatctgtattatttcttacaactgcatgtgagtctacaattgtctcaaataaaaattgaacttgaataataatatgtagacaatgctcccctttattgcctgcacgggggaggagccactcccacaccccatccttggtagccaactgctccattccaaaggtattttttaagcgagagtgttgctgaatcagtgttggattttcaatgtccaaacaccattaatttagtgcttcagagtgctgttcatgatttttagtaggaaggtttttggtttttatgagggcaattactttgtgtgccttttatggggggcgacgctggaaccatacacataactcctctccccagctgggtccacagccctgcaagcacacacggatataccaaccttttcctcttctcccatgggccaatgtgttaaggaggaaatttgtctccagaattcagccccgacccaatccttctcctatgtgcttggctaactgtgaatcaacctggctggggttgcccatgtgaccccaaccgggcaacacccacctccatctcttcccacacactacctcttccctccttcctctctccccaccatcggagaacatgtagacacacatatcagtttacaacagactcatttagttttcttttttgatttagatttattgttattgataaggtttataataacaaattaaatatttaaaatcaaaggccaattattaggtctcatttagttgcttatttcatttacttttatttaccttcccctagtgtctgaataactatcaagaaacaagtcaaacctgtgaaaatacctgttaacattcaacatatatttttatatatttctgttctatgagtcatttaattttcatcaccatggagcatgccctgctgggtataaaatgtaccctagaccttgttggctatttctctggggactagacctctggtgactttgcagatagatctcaggtctctggtattgccctgaaattactggctgcccaggggacacactggagatggttttggtcccgctgtggctcgttttgattgagctcctcattcagctggtcacggtggcctggtagtgttggcctactcccttcctggagttttcctcaagcagtggtcattttgggagaggcttcttttctggaacgccatcaaagtgtttcttttcccttgctggtttgggaacctgaaaggacaacaaggagatcacagaaaggcattggttttggggaagtggatggaggagggatggaaagacgggtttcatgagaagggatacaggctggggtggggggttgtgtcaggccaggatagggtagaagtcttgggagggaggagtcaaggggaagacgaggaggagcttgggtgggttcctcaccttgatagggcttctggaccttgattgagaaggggtcttcctcctcctcgcctctttggtgttggcaggtggttgttccacaactgggctggaggcttatggtttcttggccatcttcaccttgtcctcgtctctcaatggtctactccaggccacctggcctccccatatatacccctcccaggacaatgacgaaccacatccctaagctttgactagtcagagagccactacccatccagtggtggctctggaaggcttaaatatacaaagcaccaacctgacacctctgtggtgatggtgggggaggggtggcagtgagggggccaagatgctctggttggagaaacgtagcatttcattagcaaccctatacagccatccaaactaacctgctaccctctccatctccccatattaagttctggtgggtcacatcgtggggagagagtgttccctccaagccttcccccatggccacctcattgagtggctcactccattctctcctacccttcacgattatctaatttttgtacatcttaccaaaaatccctccaaggtaatatggccgatttagctgtatgcagagatgtgaatcatcccacttccctcctaaaaatttatcctatgtaacttgaagaccactcacttcttggttactgtcagggaaaagttccatcccgcattcttttcctagtgtccatagaggtcccttcagttttctgttttccaatctgaaatcgctgccttcaggctgtcaggctctcatgctgtaaacagccttgttctactgagtatcttattagtcttgtttcaactatgggcattgtgttcatctcagtctgtgtagtaccagatttgggttttaacaggagggatgagggagatattcatttgccagaagttgtgcggggtgtttgcatgcaggaaactacaacctaagacgtttgagttcacagaggtggagtggttgttcaacattatacttgttgctcagtgcaacgaagaaagaaaaagacctccagattggaaagggaaaagcaaaaccgtctttagtctatgcagaaacctgtacaaatctaaaataaaagtgcttctagaactaataattgaatttggcatggtcacaagataaaatatcaatacacaaaagttaattctattttatatactagcaatgagaaattggaaattgaaattaaaaacagtatgatttaaaagtaacactaggccaggcgtgaaggatcacacctgcaatcccagcactttgggaggccgaggcaggcggattacctgaagtcaggagttcgagaacaacctggccgacgtggtgaaaccccgtctctatgaaaaatacaaaaattagcagtgtgtggtggcgggcacctgtaatcccagctacatgggaggctgaggctggaggatcatttgaacctgggagatggaggttgcagtgagccgagacctcgccactgcactccagcctgggcagcaagagcgaaactccgtctcaaaataaaataataaaataaaagtaacactagaaaacatgaaatacatagacataactatgatgaaatatgtagaagatctgtacaccaaaaactaagaaatattgcagtgataaattaatgaaggataaatgcctaaataaagtttattttggtatttgtctcctaaataaatggagatagctatcttattcatgagttggaagacttactactgttaagatgtacattctttccaaattcatatatagattcaataaaatccatatcaaaaacctgaaagacttttttaaaaatagaaattgacaggctggtgttcacattcatgtataagtacaaagaacttagagtagccaaaataacttttaaaaagacaacaacacgtgtatacctgtgtaagaaacctgcacgttctgcacatgtatcccagaacttaaagtgtaataagttaaaaaaaaaagacaacaaaagttgcatgggttacactacttaatttcaaggcttattataaagtcacaataatcagaagagtgtagtattgtcataacaatagaaatgtgtcaatggaactaaagagagagtctagaaatatattcacatatatgtatttatagagaattccttattgatttgaatagacagttctcaaaagaagacatacatatagcaaacaagcatgtaacaagtgctctgcctgtttgatcatcagagaaatgcaaatcaaagctacagtgagatatcatctcaccccagttagaatggcttatatccaaaagacagcaacaacaaatgtttgcaaggatgtagagaacagagaactcccatacactgttggtgggaatgtaaattagtataaccactatgaagaacagtttgaagggtcctccaaaaactaaaaatagagctaccatatgatccagcaatcccattgctgagcatatactcaaaagaaaggaaatcagtatatcaaagagatatctgtattcccatgtttgttacagcactattcaaaacagccaagattcggaagcaacctaaatttccatcaacagatgaatggctaaataaaatatggtacatatacgcaatggagtgctactcagccatcaaaaagaatgagattctatcatttgcaacaacatggatggaactggagatcattttgttaagtcacaacagggtgactatggtcaatagtttttagttattttaaaataactaaaagaacataattgaattgtctgtaacacaaagagtaaatgcttgaggggatgggtaccccatttcacatgatgtgattattacacatttcatgcctgtatcaaaacatctcatgtacttatgagatgtacaactactatgtacccacaaaagtaagaattctttaaaaatgacacataaaatgttttaaaaatgctattcccacaattgattttccttgtcaaatattaatggtacccattttagtctaaacatccttgataaaagaaaaaacataggaagactcacacttcctgatttcaaaatttatgacaaagcaactggtcaagacagtagtggtacaaggatagaagtatagatccatgaaatagaattgagagtccagaaataaactcatgtctctggggacaactgattttaataagggtgtcaagagaacccaatgggggaaagaatgatcttttcaacaaatggtgctggggcagctagataagcacatacaaaagaatgaagtttgaccttacctcacagtatatacaaaaattaactcaaaatgaacaaaagacctaaatataagagctattactataaaatttgcagaaaacaacataggggtatatcttcatgaccttagattaggcaaataattcctagatatgacaccaaaagcatgaacagaaaaaaaatagataaattggacttcacaaagattttaaacttttgggcttcaaaggacaccatcaagacagtgaaatgccaacccagctgatgattgttcttctcagatttctcaaaactactcctgtacattgtcgtatactccctccccctctggcttctttcccctgggttccagggtccctgtccctagtgggctgaactctggattcagagctctgagtgccagcctgcctggggctctgtggacttggttttgcatgtggtctcactcatgaactctgacaattgctctcccctggatccacccaatgcccctcacgggctgagcatgtcctgtctgctctccttccgtgcctcctggtcagtctgactgaatcttttttcctcaaatgaaaaacatatgttgacatttcaaaattttaaattttaaatcatgcccagaggaatagtcttacttagaacactgcataaatccagcttcgtatgggtaagaaattaacttagtgttctaattaacctagctagaaaatgcagagacacaaattaaagtaacattgagaaaatatttttcactcatatttttgatcaaaattttaaaattaatatagtaaaatgttcacgagagtataaaatatccacatacattaatgccagatctgactggcagacgctgaccgagcgatggataaaaaatgtactcagacacaggtatccagtgaaagagaaggctaggggactgggccattcacataaagagttgtagcagccatggccccaacaagccggcactgcgggcaaatattcactacagatttaatgacaaaggctttgagtcaacacatcttgtgggtaattaacatggccgccccccagagagagcagtcctgcacacagatggttaaaggccaggtttcgggcctaagtaaactaactgatctagatcaattcctttacacttccttgttatctgctttttgctctctggctttggataagagactttggctgccttcagccaaatttttgaagcttttgcaaaacctcctggccttccaaggcttgtgtttttcctataattccttcttataatttctcccaccaccctgacctatctcttacatctcccccttttctgtttttttgcatcagattttgttgattgaagagcacagatgtgtacagcaacatgtttgtctggcacagcggttataactcatattctggctttgaatcctagaattagtaaataacataaggcaaacatgagtataattcacaacgttcttttccaatcaaggagtgacccccaggagtggggatctatccaggagagatgttctctcatacccttccgtatggctatttgttgggcttgtaggtctatggcgtttagggattctagaattttagttttaagttgctttacgtctgctgttaaattatcacgaaaggttccccagaggtgctgtttcaccttatcccaactatgtattgattgattccaaggtagagaggtaacacagatgtgcctaagctcccagtcacagtttaattgctgttggaacgcaagtgcatcttgttgctcccctacatattccaagtcagcctcaagggcttgcagatgtgcaagaatcttttgatctataccctgctgtaagagaagtacatcagacacatttctggccaaattatctacaaaagtagctgtctgtactgattcagtaatagatgctacagcaacactagcagttgctaggatgactatggctgagaccataaaggctataagtgtaactataaatcttttgcgtctgacctgggacagggcacattctaaggtggcaagggcagaggaaccttgccaattgcatgttaaattgaccggtaggaaagcctcagattgtctcctcaataccatgacactagcaatatttaaattagatatattataattagtgatacaagagatgaaccaagcctgtccctgcattcgagtcacaaacgtggagttttggggtgtaatagaaatattggttcccataaggaaaacatatggatgggtagtgcaaatcaggcaaatcaggcactgatcggtgtgattatgaaaaaaggtcatagtataattgtgactggaattatgatatgtcccatgccaggtgttaagggaagtgctaagatgtcccaggtgccataaagtgtcttggggtggcatggactctacttggggtctgggatatccctccccccatcggcccaaattataggggaacgggatgtggctacaaaactgccattgatgccaagatagacatggacatcaatacgatcgccctgcaaatggctgggaggactccagtctaagatgttataattgcttaactggaggctacaggcctgttccccgtgacagacctcccagctaaagtggaatccattactttcccagctttgttctttagcacagggaggaatgtttgggaaaatggcattgattgcattgcctggtttgaggctacctgctactaagactgttaaagcatttcctttgccacaatgtagccaaaattgtgtttgagcaggtacacagtaagggttagaacttttataacttacacacagtgggaggatagtggagtgatatgtagtgttacctggcaccttagtccactgtgtgccattaatgagggaccccactaggggtaaatctatctctcccagccaagcagttatgttattagaggctgggaagggggtgtctgcccaggtgatggggcagaagaagggcagatctaagcgatgagtccaatagagtgcagcaggtgcagattgcagacaaagcgagagcataaaaaggatcaatgccctacatgagttgcaatgtacaacagagagcatagcaaggaacaaattatctggagtgaatggtgtctgtgtccggagcaggattcgctcggcctcctgagttgtcttcttcagcatcccccaggtaatgtctggggcttgtgtcatccgaggaagcagtattgtctggggctgcgggtcctgcagggtcattttcttcatttctggtatgggttgggtcctagtcatgccatggtatggtttgatgcatcctgctggaatccaaagaggatctgagggggtgtgaacacaagcatatcctttcccccatttaagcaattcatttggaccataccatacattactgtttacaactttctgtaaaacagcaggttttatgtcttgagaggttttagcaaagtgcttttctacagctgatggaaatttatctttaaatttaaaaaattaagggtaaataaggcttgtgccaatagtgttgcagtgtccttaactcatattcccccttttttgtttttttgagcatatttttaaaggtgaaatggacatgttctactatggcctgtccttggggggttatgcgggatgcctgtggaatgttggatgttccacatgtgacaaaattgttgaagctgtgagctggcataagccagaccgttatcagttttattttttgtgggccgccccataaatgcaaaagttaaaagaagatgtttaatgacatatcgggtggactctccaggaaaggcatgagcactaattacatgagaattggtatcaatggacacatgtacatatcttagttttccaaattcagggatgtgtctaacatctgtttgccataactgattaggttctagtcctctagggttaacacctgtagaaggaggggatgtgcctgtgagctggcaatctgggcattgcaggataatttgtctagctactctctggataagttgaaatcgtttggataagtttctccaattttggtgggaaaattgatgttattgggtggattggttaagccgtgatgtcaccacttgtaggtctgcttgttcattgtcataagccagtgggccaggcagtgagctgtgggctcgaatatatgtgataaaaataggatgtgtacgttgatctagcaattgctgaagtcgaacaaaaagtgcacacagtgtgggctccagagtggacttaatgagggttgtttcaaggttctgcagtaaataaatagagtaagcagggtcactaacaatattgatgggttgagcgaaaaaattctcgaaggccaatattaaggctccaacttcagctctctgagtgctagtaaatccagaatgaatgagggaattatgcggtctccaccaaatagccgctgttccatgtttaccagagccatcggtaaacagtgttaaaatgttaggtatgggggagtgagctatttttgcaggcaaaaccacagaagtatgagataagaactgaagtcatttatcagcaggaagggcatgctctacatggcctgtgtaatcagagagtgctgtttgcaggcctaaagataaaggcaatactgcttcgaattgctttttactcaaaggaattctgatgacatcaggatcataacctagcaacctattgcattgtctgcggcctgaatggatgactttactaattagctggatatatagagagagtgttttagtcctattatgtgggcaaaaaacccattctagaaagtgcagccctgggcccatctgtcctattaatcctcttggggaatgtttagtgggaaaaacaaacaactgaactgaatatcatggatctatgcaatctagttgcctgtgagaaatagcttgctctactccctcaatttccctttatgctgcaggagttaagtgcctagaagagtctagagcagcattgccttttaatatagaaaacaggttttggaacttataagtagttatgcctaaggtggggcgaagccagttaatattgcctagtaatttctggtcattatttaaggtgtgtaagttgctagtatttaatttaaccttttgaggttttgctgaccgggaagttagtatgtgcccaaggtatttcctaggagaggacatttgtactttttcaggtgctatgattgaacctcttaactgcgtgttctttacgacagaggaatataaacttaaaagtactggctctgttggggctgctggtaaaatattatccacaaaatgaataatcttgcaattaggaaattattttctactggggagcaaagcttgatttacatgttactgacacatggtaggactgttcagcattcctggaggaagcactttccaatgaaatctgcaagctggcctttcattattgatagctggtattgtaaacgcaaatttttctctgccctgttttgcaaggggaatagtacaaaagcactcttttaagtcaataacaactgtaggccaatcttgaggaatcgccgtgggggaagggagcccctgttgaaggggccccataggttacaaattagcattaatagcacataagtcatgcaaaagtctccatttaccagactttttgggaatgacaaaaatgggcaaattctaagggctatttgatggttctatatggctggcttttaattgctcctcaactagttcatgggctctttgtaatttctctccctttaaaggccactgttctacccaaactggatctagagagagacacgtgaggggtaggggaagaattacaacagtggccattattagaaaggggtctgtagagtgatccccacattgggctaataggtcccgcccccaaagattaacagggatggacatgattagaggttgtataactgtttttcttccctccaaatcgcaacatattagggggcgtgtgctctgcttggctgtgtgcgcttccccgatgccgacaatttttcgtttctgagtgaccgaaggccaagtttctggccagttttgatcgctaatgattgaaatatccacctctgtgtccaataagctagtaacatttttatttccaatttttaaggtaatcatgggtctctgataagcgattaattggttccaatatactcctgtggctcccgtgcttccaaaacttccctttcccctttcttttccctgggctttggggacccagtatggtaagagtattaactgggctatctttgatccagggagaagaatatgcagacctttacgttccatcataactaatatttcactttgataatcactatcaattacccaagtgagcacattaatcccttgactggatagccttgattgccctaggactaatcccactgttcccggaggcagtgggccccagatcctggttgcaacccttttagggtcttctctttcttttagcactaattcgttggggcagagttaagtccagtcctgcgctcccagtggtggctgctctgagagagaggactgtgggctttccatctgactgaagaaagccgctggcattgcccgtttggagcggggcctggggctggcccctcatgaagtttcccgcctgattacttagggggttgctgtttttatcaaatttggacccgcactgatttgcccaatgtttcccctttttatatcagtggcatatagaagggggttcttttcctgaattaccttgctctctactactggggcattcctgcttcatatggcctggctctccacatagaaaacaatttgggtttctctcctttttcactttaggaggccttaatgccatagccaatatttttgctttgtgtgtttcagtccccaccagttgacacgcttgtataagttccccaactatggctgcctttcctctgattgcctgcattgcttgctggcagtcgatgttagcattttcataagccaattgcaacaataagataacagcggcctgggcatgactaatttgtcttttaattgcctgggttaaccgattgataaattcaacaaatggctcctgaggcccttgtcaaacatttataaaagatccctgttgaactctgctctcgggaattcagtcccaagccctgagagtgcacaaagacacttgtgcataggcctggggatcaaaatttagttgttgttgtgcatcagcatggggacccctcgcctggagcatagcagctgttatgttttgcccggccaattgattctggttggcttgttgttcgcatattctgccctccagaggaggtattggctgggccccaaagttgttttagctagcactgaccagtcccatggggtcatacagaagttgtctgacatggcttcaattattccttttgcaaatgggctagtggctctgttttctttaatgctttttcttatctctttataagcattaaaagaaatgggttcatatacccgattgccttgttgattttgcattaccaggcaggccaagagctccccttcaaatgccacttgcctaagatagggtcctatagctgtagcgtatcccttgtcttttttccaatttattggaggagagggcttaggcaaaacctctttggtacatttgcccagaaacagccgggctgagggagatagaagtggtaaggtaggttatggttcctcctccctcccctttttaggctcttctgtgtatagcgggaccaaagcaaccctaactaaagcccataacgttagagatgttactgggacccgctgcccttgtgcatgatgttgtttaagatttctcccaacttgttcccagagctctacgtctagcgtaccttcttccgggaaccatgggttatgggaagcaacagtttgcattaggtcccttaactgagcctgcgaaactgaggctctgctagctttaagcagctgtttcaatacttttatatactgttgctgttgcgctgatacctgttgtccgatgatgaaaccctagcctgaacaattcctttgaacttagaaatcccgagcgggcacctatgacttattgacttaatgactgcgcagtctcttcaccttcgttttcgagggttccgttgtgatccgttgcagtgttcctcacacggggcaccacctgccgggtctgaccggcagaccctgaccaagcgacagatgaaaaaatgtactcacacacaggtatccagtgaaacagggggctaggggactgggctgttcacagaaagagttgtagcagcctcggccccaacaagccagcgctgcaggcaagtattcagtacagatcctttgagtcaatacatcttgtgggtaattaacatggttgccccccacagagagagcagtcctgtgcatggatgattaaagaccaggttctgaggcctaagtaaactagcttatctagatcaatttatttacacttccttcttatctcccttttgctctcaggctctggataagagactttggcggccttcagccaaattatctttcgaagcttttgcaaaacctcctggccttccaagaaggtttgtgtttttcctataactccttcttataatttctctcactaccctgactgatctcctacacattaatctgtgagaacatgaattgcttcagattttggattgaaaggtctgcaatatttataaaactgtaaactgtttccaccctttcctctttaacctcatgttcacattgttaagtatttcttagtaaaaaaaatgcacatttgcacaataattcatgttcaatgatgttgattttagttctattaatcataacaagtagagaacaatttatttatctgtcaggtatagaatggtttaattgattatggcatattaatgctttaagattctagagagtggttacaaaatcgagggagatacatacatactgtcatggtaagattctgtatccattttattaagtggtaaaggcaagtagcatatcaatatatacatcattatcaaaatgaccaatatgctagtatttgcatagcacatctatatataagaagcctaaaatcagctttaaaataatacatatcagattaataattatggtgaactctgtgatggggcttaaattgtggaaggactttggaaagggagaaattacaatatatctgtatatttagattgtttgcaacaagaatacatatacacactgctatttttgtgatgagactctttaaataagaaaagcagcaaaaatagttgctgtgtattagtcagtaaaaataaccgctagttgatgcaacagacaaaccctaaaatttgaatggattgacacaagaaaagtttattttatgtgcccataagttctgatgcggtttggcaggggctctccactctcacatgacccagggatccaggctgcttccaccttgtgattccatcatctcaaaatgaaactgccatgtttactgttggatggaggaagaaaacttggaaatggcacactggttctcaaatgcttggatgtgacaaacaacacttctgctcatgtttcagtggtaacaagtggtcacatgacccttcctaactgcaagtgggctgtactgttcccatgtgtccgggaaggagacaaagacaaaatgtgagtgagtggtatagtctcccccataaactgttatgtaggaggtgctcaaaaaaagcaattatgataatttggtattacacaacccttgtcattgctagagtttctgagaagcccacatttgccttgaagttctctaacattttcaagtgcctgctacgtgactgatgctttgaaatgtaagatcacaactgtccaagaactttgaaagtctcagcaggaaggctcatcagggaatcttccctttataataccctttaaacaattagtaggctttgaacttttcctccatttgattcctggtcaaaattttaacctgtgagtttctgctacccttcacatgcctaaacacctgtcaggtgcctttagacacaatgaaagcacatattttcctgtggggcaagtactagacaagagaaagtagaaacttggttaattattctactaaaatttgagctagtactcccaccaaggcagcatttttcacctcctgggagactctggggttttagttcagcctcagtagatgttgactccacagtgatttccatgttctttcctcatctccagcttatgcgagagagtttagattttcaccaccaaggtaaggtcattcatccttgtatgtgttcagtgaccagtttcaaataaaacaccccattaaattcctattacgaataacaaaatggctttaaaaaactctctctctgtaacttcgtatctcaagaatagtatatcatgtgctaatcacattccactcaccatctatttagaaaagttcgagggtgtatttagacacacagttgggatgacaggatgtgtaaaggggaaggcaggtgattccgcttagccttcacagcaagcagcagggaggagcaggaagcaggccagattccaattggaagaaagggcacatgagggagaccaagggaaggcctctgtggcgcgagaaagtgttagggttggacagaaattcctgcacttgggtagagtcagctctcaggaaccctagggctcaggcaggaggaccctaggttaataaagcccacagactatccccagattatgtttcattctcattgtcaccttccttttgtaggcccgctttcagtaccacgtccacagtgtccttcttttggccacttgagagacattatgcagtactgagaaaacaaatgaattaagggacagaggtgtacttcaggctgcaaagagtgagaatagaatgggctctagatgaattcaggccaaccttgtggtttaccagtgatatgatcttgggaaagttaccaagcaccatgagactcaggttcatccagaaaatgggtttgatagaccatttttttaggactgttgtaatgtataaaatgtattaaaacacctgggatgatgcctggcatgtactggatatttaatgattgacagctatttctagtattactgtgaccccaggtgctaccactctctactttggaatattttttattgtccaggacatctcagagaatctgcaactcagtaggaaactgcatttccttggtgaatatgtatgtggggggaggggggtgtacatgtgtgtatgggtgtgtactttcatagaacaacagattaatatggataagaagacaagaattaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatctactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttcccccccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacatgtctcttattcatttgactatttcaagtgtgcatttttttgaattttctagatagactgttgcattaccctaccaaatatcactctttctttccaatatacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccattttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactataagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacccatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtttcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattcgaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggttacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctccccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctagtttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgctatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcacaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatgtgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccataccctggaggacacaatgctgctcagggagaacaggaagaatctgaacagacaggccttgctggtttcccaactcagtctcttagtattaggttatatctttctgtccaatcatatttctacacatctgtccatgcttcaatcatgcctatccaatgaagtcttagtaaaagggtcaggaggacaggatattgagagcttctgaacagctgaattcatggaggcttccagaaaggtgcataagaactcatccacgtgccaggagagtgctgcaccccaactgcatgggaacagaagcccttgcagggcagaccctccagaactcgccctatgtacctctttatatggctgtttcattgtgtcctttaaaatatcctttgttataaaccagtaaacataaatatctccctgagttttgtgagctgatccagcaaatcaagcctaaagaaggggtcatgacaacctgaagttgaagccaatcagttagaagttccagaggcctggacttttgactagcatctgaagagagggcactgttgtgggactgagtcctcaacctgtggatctgatgctatctccagatagatagcgtcagaatggaattgaattaaaaggcacctagctggtgtctgctgtagaattgatttcttgctttttggtgaggagaaatccccatacattcagtcacagaagtcttctgtgttgattgttgtggtgtgaaagcagatgaaaacagatgaaagcagatgaaatgccctggtgcattcagctaccgggcctgctcactcacatcacgtggccatgttcagctggagattatggttcccagatttcccaagcctattcctgctcattgtcctgtcctccctactgcctttccccttatatccctcaggtccctgatcccactgggctgaactctggattgagagctctgagtgccagcctgcctggggctctgtggacttggttgtgtgcgtggtctctctcatggactctggcagttgccctttcttggatcctcctaatgcccctcatgagctgatggtgtcctgtcttctctccttccctgccatctggtcagtctgactgcattagtccattctcatgctactataaagaactggcagagactgggtaatttataaaggaaagaggtttaattgacacaaagtttcacaaggctagagaggcctcaggaaacttacaatcatgcaggaggggaaacaaatatgtccttcttcacatggtggcagcaaggagaagtgctgagcaaaaggggaaaaagccccatataaaaccatcagacaactcactcactatcacaagaacagcatgagggtaaccatccccatggttaaattacctctcaccatgttcctcccatgacacatagggattatgggaactaccattcaagatgagattttggtgggacacagccaaaccacaacattctgcccctggcccctcccatatctcatgtcctcacatttcaaaacaaaatcatgccttcctgacagtctcccaaagttttaactcatttcagaattaactgaaaagtacaacttccaaatctcatttgagacaaggcaagtcccttctgccgatgagcccgtaaaatcaaaagcaagttagttacttcttagatacaatgggggtaaagacatccattccacctgggagaaattggccaaaacaaaggggctacaggccccatgcaagtccaaaatccaataggtcagtcattaaaccttaaatttccaaaatgatctcctctgatttcatgtctcacatctaggtcacgctgatgcaagaggtggtctcccatggccttgggcagctctgcccctgtggcattgcagggtacaaccccccacccaacttccctcaaggaagatcccattctgggatctggaggactgtagttctcttctcacagttccactagggaataccccagtgaggacactgtgtggaggctccaaccccacatatcctttcatcactgctttagcagaggttctccatgagggccccacccctgcaagaatcttcttcctgaacatccaagagtttccatacatcctctgaagtaggcagaggttgccaaacctcaattcttgacttccctggaccggcaggctcaacaccacagggaagctgccaagacttggtgattgcaccctctgaagccatgacccgagctgtaccttggctccttgtagacacggctggaggggctggaacacagggcacccagtccctgggctgtacacagtatggtggccctggcccaggaaactatttttccctcctcagcctctggacctatgatgggaagggctgccgtgaaggtctctggcatgctctggagacattttccccattgtcttggtgattacatttgtctccatgttacttatgcaaatatctgcagttggcttgaatttctccccagaaaacgggattttcttttccactgcattgtcaggctacaaatgttccaatttatatgctctttcaccttttgaatgctttactgcttagaaatttcttctgctagatacgctaaatcatcactctcaagttcaaagttccacagatctctggggcaggggcaaaatgccaccagtctgtttgctagcatagcaagagtcgtctttattccagttccctacaagtttgtcatctctatctgagaccacttcagcctggacttcattgtccatatcactataagcattttggttaaagccattcaacaagtctctggaaagttctaaactcctacatcttcctgtctcctgagctctccaagtctctaggaagcttcaaactttcccacattttcctgacttctgagccctccaaactgttccaacctctgcctgttactcagttccagattcgcttccacagttttggtatctttacaacagctcgccactacccgttaccaatttactgtattagtccattcttatgctattataaagaactgcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaactgcccaagactggttaatttataaagaatagaggtttaattgactcagtttcacagggctggggaggcctcaggaaacttccaatcatggtggaaggggaagcaaatatgtccttcttcacatagcagcagcaagaagtgcccagccaaagggggagaagctccttatacaaccatcagatctcatgagaactcactcactatcacaagaacggcagcatctgggtaaccactcctatgattcaatcacctcccacggatacctcccatgacacgtggggattatgggaactacaattcaagatggcatttgggtggggacacagccaaaccatatcactgaccaaacccttctcgaagtaaagataaatgggaatttcgtgtcagaagatgtttactgcacagtgatttccatggtctttcttcatgtaccactgtgagagaggctatggttttgaccacctaggaaagtttgtttatatgctcagtactcagttttaaataaggctacatcaaaggcattcttcatttctgttacattacctttgaattctagcactcactttagattatttaatacagttttcacctctttgctgtcatttcccatctattcttgtgtgttgtctactttttttattagaccttaaacatatgaatcactgatattttatattcatattttataagtataaaatttgtgttatactcagtctgcttttgcaacttgctttgtcacctcaggctctttttccttgccttgcgtcatgctgtggaagtttttgtgaaaaactgaatgtgatgtatttggtaatagtaaaccaagatgaaaagcttttagtgtgatactttctgttaatttgactaggtcttggacagggcttaatgtttgctgcagctgtaggtgccaaagccttcaatgccctgcagtattcttttttgtctccctcctattgtctttggttttcttaataactaccaattaaattaagcctctgtcttctagctcttcatccattgtaatccactgtcgatgtggttgtatcatccattgtaatccaccatcaatgtggttgtaaggtgttagggaaagaattgaaaccatctttgtaaatgttatacaattaatcagggaagaagagaggaggagaaatgaaaacaaaccaagctttcagcacagtcagcattaatcactaggttagcttgctctctgacccactcctcatagtcatttgtctctgcctcaaaatcacacagaccttgttatcagattataggtccccataattgctctatagatagcaacttaaacattctgaaacgttaagttttccttttgagatattctttccaatccttcataccagtgaaacctactgattgtagctggtctgaaggaccccaggaggagctggctcacggaagaatgcagtttccacatcctgatgacttcatccctcttaccccaaacaatcaacgactccaactttcagccccttgccctccatgatcctcttaaaaactgtcacgcgtatccatgtgaaaagaccaccaaacaggctttgtgtgagcaataaagctttttaatcacctgggtgcaggcgggctgactccaaaaagagagtaagcgaagggagataggggtggggcagttttataggattttggtgggtagtggaaaattacagtcaaaggggggttttctcttgcaggcaggggcgggggtcacagggtgctcagtggggcagcttctgagccaggagaaggaatttcacaaggttaatcactcagttaaggtagggcaggaacaaatcacagtggtggaatgtcatcagttaaggcaggaaccagccattttcacttcttttgtgattcttcacttgctttaggccatctgaatgtatatgtgcaggcttcggctcagaggcctgacaaaaatctcatcccagaactccttggggagatggatttgggggtctcctcccatctccttactcagggccctgtgatgattaaactctttctcttctgcaaactttgctgtcttagcgtattcaactgttactgctcagtgagcacatgaacctgttggtcctataacaggatcattcttaatcttatgattgaattgcaggacttattgaatatgtgtctctgagttgtggccttcgtgactgtttcaccagcagtatagtttctttgccccatttcccccaaatccttttgctcactcctgtgttcctaagcaaagaaagactgtcaaatcaggcagctccagaaccaaaataggttcagagcaactccagggttgccacgtggtgagataatatttgtgaaccaataaaggatagtaatatacagaaaacagaaatgacgtacagaaagaactggattggcaacagctggggatttgccttgtttgaacctgctttgaacagttggctgcctgtggttgactaagactcagttgcttgttacaaggtatattacaatctgtctatacttcaagttaggttacacttcactatgtgtagaggaatctttaggccaaccttcaaatatgtagaggggaagctttagatcaaactcaatttgatatcctttaggtaagacaagaaagctagaagtttgcagtgggaggaatgccattccccaagctgggatgacgctatggcaaagccttttactgctggagaacacctttgttatggagaaggctctgagtgtttttcacaatagctatttttctcctactcctgcccagatgaatgagagaagcttgctcagaccttcacggtgagaattcgctgatgctcctggaggtaaagcactcaacaatttgcctcccaagactgtggctgccaagtaatttatcactctcatggtactccacattcagcatctaaaatttcattcaattaccatttaaaggttttttactaggttacagacccagaattgtctactcctgataagtatatcttagctttgcctctttgtacctgactctcctgattttgggtggtaatttgccctgcaacatcaattccttagtatgtgtgagaaaaataactgattttcagtttgccaagcatatttttgtagtaaaaatgaccatgtcagtgttcaacacctttacagtcagggctgaagttagaagccctgtattaactttttagttaccgatttatattatgtatacctgttagagtaggcagatagccagaaatgagcaggcaagggagtccctgggaaaagaagtcctgggagacactgcccactgacaatcagaaaaaaataaaaataaaaataaaaataaaaaccaatggctatattggctacagctggccttgtggttaggctcttccagcccagaaggggtcttaccaggccctaactggaggcaacaatggtagggacttttcctactgaggagcatgcacactcctcccataaatcaccctggagtagccttttgcttattataatagtgaaaaacacaccctggggtggagactttaaatgctaatgagacatgccacatgtgtactagtatgcacaaccacagagcatgtgcggtcaaggggaccacataaaacatgattgcaagtgacattccgtcatgccccttcatgaataatcatgtaagattctcataaagagagtcccccagcactagctgctgctggctcattctctctttcaacagcccactctgatttgtcttccagagtgtactgtctctttaaataaacactgctattgctctttttccagccaaaccagccaaggtttgtcctagggcaatcaaggctatccagtcaagggattaatgtgctcacttgggtaattgatagtgattatcaaagtgaaatattagttatgatggaacgtaaaggtctgcatattcttctccctggatcaaagatagcccagttaatactcttaccatactgggtccccaaagcccagggaaaagaaaggggaaagggaagttttggaagcacgggagccacaggagtatattggaaccaattaatcgcttatcagagacccatgattaccttaaaaattggaaataaaaatgttactagcttattggacacagaggtggatatttcaatcattagcgatcaaaactggccagaaacttggccttcggtcactcagaaacgaaaaattgtcggcatcggggaagcgcacacagccaagcagagcacacgccccctaatatgttgcgatttggagggaagaaaaacagttatacaacctctaatcatgtccatccctgttaatctttgggggcgggacctattagcccaatgtggggatcactctacagacccctttctaataatggccactgttgtaattcttcccctacccctcacgtgtctctctctagatccagtttgggtagaacagtggcctttaaagggagagaaattacaaagagcccatgaactagttgaggagcaattaaaagccagccatatagaaccatcaaatagcccttagaatttgcccatttttgtcattcccaaaaagtctggtaaatggagacttttgcatgacttatgtgctattaatgctaatttgtaacctatggggccccttcaacaggggctcccttcccccacggcgattcctcaagattggcctacagttgttattgacttaaaagagtgcttttgtactattccccttgcaaaacagggcagagaaaaatttgcgtttacaataccagctatcaataatgaaaggccagcttgcagatttcattggaaagtgcttcctccaggaatgctgaacagtcctaccatgtgtcagtaacatgtaaatcaagctttgctccccagtagaaaataatttcctaattgcaagattattcattttgtggataatattttaccagcagccccaacagagccagtacttttaagtttatattcctctgtcgtaaagaacacgcagttaagaggttcaatcatagcacctgaaaaagtacaaatgtcctctcctaggaaataccttgggcacatactaacttcccggtcagcaaaacctcaaaaggttaaattaaatactagcaacttacacaccttaaataatgaccagaaattactaggcaatattaactggcttcgccccaccttaggcataactacttataagttccaaaacctgttttctatattaaaaggcaatgctgctctagactcttctaggcacttaactcctgcagcataaagggaaattgagggagtagagcaagctatttctcacaggcaactagattgcatagctccatgatattcagttcagttgtttgtttttcccactaaacattccccaagaggattaataggacagatgggcccagggctgcactttctagaatgggttttttgcccacataataggactaaaacactctctctatatatccagctaattagtaaagtcatccattcaggccgcagacaatgcaataggttgctaggttatgatcctgatgtcatcagaattcctttgagtaaaaagcaattcgaagcagtattgcctttatctttaggcctgcaaacagcactctctgattacacaggccatgtagagcatgcccttcctgctgataaatgacttcagttcttatctcatacttctgtggttttgcctgcaaaaatagctcactcccccatacctaacattttaacactgtttaccgatggctctggtaaacatggaaaagcggctatttggtggagaccgcataattccctcattcattctggatttactagcactcagagagctgaagttggagccttaatattggccttcgagaattttttcgctcaacccatcaatattgttagtgaccctgcttactctatttatttactgcagaaccttgaaacaaccctcattaagtccactctggagcccacactgtgtgcactttttgttcgacttcagcaattgctagatcaacgtacacatcctatttttatcacatatattcgagcccacagctcactgcctggcccactggcttatgacaatgaacaagcagacctacaagtggtgacatcacggcttaaccaatccacccaataacatcaattttcccaccaaaattggagaaacttatccaaacgatttcaacttatccagagagtagctagacaaattatcctgcaatgcccagattgccagctcacaggcacatcccctccttctacaggtgttaaccctagaggactagaacctaatcagttatggcaaacagatgttagacacatccctgaatttggaaaactaagatatgtacatgtgtccattgataccaattctcatgtaattagtgctcatgcctttcctggagagtccacccgatatgtcattaaacatcttcttttaacttttgcatttatggggcggcccacaaaaaataaaactgataacggtctggcttatgccagctcacagcttcaacaattttgtcacatgtggaacatccaacattccacaggcatcccgcataaccccccaaggacaggccatagtagaacatgtccatttcacctttaaaaatatgctcaaaaaaacaaaaaagggggaatatgagttaaggacactgcaacactattggcacaagccttatttacccttaattttttaaatttaaagataaatttccatcagctgtagaaaagcactttgctaaaacctctcaagacataaaacctgctgttttacagaaagttgtaaacagtaatgtatggtatggtccaaatgaattgcttaaatgggggaaaggatatgcttgtgttcacaccccctcagatcctctttggattccagcaggatgcatcaaaccataccatggcatgactaggacccaacccataccagaaatgaagaaaatgaccctgcaggacccgcagccccagacaatactgcttcctcggatgacacaagccccagacattacctgggggatgctgaagaagacaactcaggaggccgagcgaatcctgctccggacacagacaccattcactccagataatttgttccttgctatgctctctgttgtacattgcaactcatgtagggcattgatcctttttatgctctcgctttgtctgcaatctgcacctgctgcactctattggactcatcgcttagatctgcccttcttctgccccatcacctgggcagacacccccttcccagcctctaataacataactgcttggctgggagagatagatttacccctagtggggtccctcattaatggcacacagtggactaaggtgccaggtaacactacatatcactccactatcctcccactgtgtgtaagttataaaagttctaacccttactgtgtacctgctcaaacacaattttggctacattgtggcaaaggaaatgctttaacagtcttagtagcaggtagcctcaaaccaggcaatgcaatcaatgccattttcccaaacattcctccctgtgctaaagaacaaagctgggaaagtaatggattccactttagctgggaggtctgtcacggggaacaggcctgtagcctccagttaagcaattataacatcttagactggagtcctcccagccatttgcagggcgatcgtattgatgtccatgtctatcttggcatcaatggcagttttgtagccacatcccgttcccctataatttgggccgatggggggagggatatcccagaccccaagtagagtccatgccaccccaagacactttatggcacctgggacatcttagcacttcccttaacacctggcatgggacatatcataattccagtcacaattatactatgaccttttttcataatcacaccgatcagtgcctgatttgcctgatttgcactacccatccatatgttttccttatgggaaccaatatttctattacaccccaaaactccacgtttgtgactcgaatgcagggacaggcttggttcatctcttgtatcactaattataatatatctaatttaaatattgctagtgtcatggtattgaggagacaatctgaggctttcctaccggtcaatttaacatgcaattggcaaggttcctctgcccttgccaccttagaatgtgccctgtcccaggtcagacgcaaaagatttatagttacacttatagcctttatggtctcagccatagtcatcctagcaactgctagtgttgctgtagcatctattactgaatcagtacagacagctacttttgtagataatttggccagaaatgtgtctgatgtacttctcttacagcagggtatagatcaaaagattcttgcacatctgcaagcccttgaggctgacttggaatatgtaggggagcaacaagatgcacttgcgttccaacagcaattaaactgtgactgggagcttaggcacatctgtgttacctctctaccttggaatcaatcaatacatagttgggataaggtgaaacagcacctctggggaacctttcgtgataatttaacagcagacgtaaagcaacttaaaactaaaattctagaatccctaaacgccatagacctacaagcccaacaaatagccatacggaagggtatgagagaacatctctcctggatagatccccactcctgggggtcactccttgattggaaaagaacgttgtgaattatactcatgtttgccttatgttatttactaattctaggattcaaagccagaatatgagttataaccgctgtgccagacaaacatgttgctgtacacatctgtgctcttcaatcaacaaaatctgatgcaaaaaaacagaaaagggggagatgtaagagataggtcagggtggtgggagaaattataagaaggaattataggaaaaacacaagccttggaaggccaggaggttttgcaaaagcttcaaaaatttggctgaaggcagccaaagtctcttatccaaagccagagagcaaaaagcagataacaaggaagtgtaaaggaattgatctagatcagttagtttacttaggcccgaaacctggcctttaaccatctgtgtgcaggactgctctctctggggggcggccatgttaattacccacaagatgtgttgactcaaagcctttgtcattaaatctgtagtgaatatttgcccgcagtgccggcttgttggggccatggctgctacaactctttatgtgaatggcccagtcccctagccttctctttcactggatacctgtgtctgagtacattttttatccatcgctcggtcagcgtctgccagtcagatctggcattaatgtatgtggatattttatactctcgtgaacattttactatattaattttaaaattttgatcaaaaatatgagtgaaaaatattttctcaatgttactttaatttgtgtctctgcattttctagctaggttaattagaacactaagttaatttcttacccatacgaagctggatttatgcagtgttctaagtaagactattcctctgggcatgatttaaaatttaaaattttgaaatgtcaacatatgtttttcatttgaggaaaaaagattcagtcagactgaccaggaggcacggaaggagagcagacaggacatgctcagcccgtgaggggcattgggtggatccaggggagagcaattgtcagagttcatgagtgagaccacatgcaaaaccaagtccacagagccccaggcaggctggcactcagagctctgaatccagagttcagcccactagggacagggaccctggaacccaggggaaagaagccagagggggagggagtatacgacaatgtacaggagtagttttgagaaatctgagaataacaatcatcagctgggttggcatttcactgtcttgatggtgtcctttgaagcccaaaagtttaaaatctttgtgaagtccaatttatctattttttttctgttcatgcttttggtgtcatatctaggaattatttgcctaatctaaggtcatgaagatatacccctatgttgttttctgcaaattttatagtaatagctcttatatttaggtcttttgttcattttgagttaatttttgtatatactgtgaggtaaggtcaaacttcattcttttgtatgtgcttatctagctgccccagcaccatttgttgaaaagatcattctttcccccattgggttctcttgacacccttattaaaatcagttgtccccagagacatgagtttatttctggactctcaattctatttcatggatctatacttctatccttgtaccactactgtcttgaccagttgctttgtcataaattttgaaatcaggaagtgtgagtcttcctatgttttttcttttatcaaggatgtttagactaaaatgggtaccattaatatttgacaaggaaaatcaattgtgggaatagcatttttaaaacattttatgtgtcatttttaaagaattcttacttttgtgggtacatagtagttgtacatctcataagtacatgagatgttttgatacaggcatgaaatgtgtaataatcacatcatgtgaaatggggtacccatcccctcaagcatttactctttgtgttacagacaattcaattatgttcttttagttattttaaaataactaaaaactattgaccatagtcaccctgttgtgacttaacaaaatgatctccagttccatccatgttgttgcaaatgatagaatctcattctttttgatggctgagtagcactccattgtgtatatgtaccatattttatttagccattcatctgttgatggaaatttaggttgcttccgaatcttggctgttttgaatagtgctgtaacaaacatgggaatacagatatctctttgatatactgatttcctttcttttgagtatatgctcagcaatgggattgctggatcatatggtagctctatttttagtttttggaggacccttcaaactgttcttcatagtggttatactaatttacattcccaccaacagtgtatgggagttctctgttctctacatccttgcaaacatttgttgttgctgtcttttggatataagccattctaactggggtgagatgatatctcactgtagctttgatttgcatttctctgatgatcaaacaggcagagcacttgttacatgcttgtttgctatatgtatgtcttcttttgagaactgtctattcaaatcaataaggaattctctataaatacatatatgtgaatatatttctagactctctctttagttccattgacacatttctattgttatgacaatactacactcttctgattattgtgactttataataagccttgaaattaagtagtgtaacccatgcaacttttgttgtcttttttttttaacttattacactttaagttctgggatacatgtgcagaacgtgcaggtttcttacacaggtatacacgtgttgttgtctttttaaaagttattttggctactctaagttctttgtacttatacatgaatgtgaacaccagcctgtcaatttctatttttaaaaaagtctttcaggtttttgatatggattttattgaatctatatatgaatttggaaagaatgtacatcttaacagtagtaagtcttccaactcatgaataagatagctatctccatttatttaggagacaaataccaaaataaactttatttaggcatttatccttcattaatttatcactgcaatatttcttagtttttggtgtacagatcttctacatatttcatcatagttatgtctatgtatttcatgttttctagtgttacttttattttattattttattttgagacggagtttcgctcttgctgcccaggctggagtgcagtggcgaggtctcggctcactgcaacctccatctcccaggttcaaatgatcctccagcctcagcctcccatgtagctgggattacaggtgcccgccaccacacactgctaatttttgtatttttcatagagacggggtttcaccacgtcggccaggttgttctcgaactcctgacttcaggtaatccgcctgcctcggcctcccaaagtgctgggattgcaggtgtgatccttcacgcctggcctagtgttacttttaaatcatactgtttttaatttcaatttccaatttctcattgctagtatataaaatagaattaatttttgtgtattgatattttatcttgtgaccatgccaaattcaattattagttctagaagcatttttattttagatttgtacaggtttctgcatagactaaagacggttttgcttttccctttccaatctggaggtctttttctttcttcgttgcactgagcaacaagtataatgttgaacaaccactccacctctgtgaactcaaacgtcttaggttgtagtttcctgcatgcaaacaccccgcacaacttctggcaaatgaatatctccctcatccctcctgttaaaacccaaatctggtactacacagactgagatgaacacaatgcccatagttgaaacaagactaataagatactcagtagaacaaggctgtttacagcatgagagcctgacagcctgaaggcagcgatttcagattggaaaacagaaaactgaagggacctctatggacactaggaaaagaatgcgggatggaacttttccctgacagtaaccaagaagtgagtggtcttcaagttacataggataaatttttaggagggaagtgggatgattcacatctctgcatacagctaaatcggccatattaccttggagggatttttggtaagatgtacaaaaattagataatcgtgaagggtaggagagaatggagtgagccactcaatgaggtggccatgggggaaggcttggagggaacactctctccccacgatgtgacccaccagaacttaatatggggagatggagagggtagcaggttagtttggatggctgtatagggttgctaatgaaatgctacgtttctccaaccagagcatcttggccccctcactgccacccctcccccaccatcaccacagaggtgtcaggttggtgctttgtatatttaagccttccagagccaccactggatgggtagtggctctctgactagtcaaagcttagggatgtggttcgtcattgtcctgggaggggtatatatggggaggccaggtggcctggagtagaccattgagagacgaggacaaggtgaagatggccaagaaaccataagcctccagcccagttgtggaacaaccacctgccaacaccaaagaggcgaggaggaggaagaccccttctcaatcaaggtccagaagccctatcaaggtgaggaacccacccaagctcctcctcgtcttccccttgactcctccctcccaagacttctaccctatcctggcctgacacaaccccccaccccagcctgtatcccttctcatgaaacccgtctttccatccctcctccatccacttccccaaaagcaatgcctttctgtgatctccttgttgtcctttcaggttcccaaaccagcaagggaaaagaaacactttgatggcgttccagaaaagaagcctctcccaaaatgaccactgcttgaggaaaactccaggaagggagtaggccaacactaccaggccaccgtgaccagctgaatgaggagctcaatcaaaacgagccacagcgggaccaaaaccatctccagtgtgtcccctgggcagccagtaatttcagggcaataccagagacctgagatctatctgcaaagtcaccagaggtctagtccccagagaaatagccaacaaggtctagggtacattttatacccagcagggcatgctccatggtgatgaaaattaaatgactcatagaacagaaatatataaaaatatatgttgaatgttaacaggtattttcacaggtttgacttgtttcttgatagttattcagacactaggggaaggtaaataaaagtaaatgaaataagcaactaaatgagacctaataattggcctttgattttaaatatttaatttgttattataaaccttatcaataacaataaatctaaatcaaaaaagaaaactaaatgagtctgttgtaaactgatatgtgtgtctacatgttctccgatggtggggagagaggaaggagggaagaggtagtgtgtgggaagagatggaggtgggtgttgcccggttggggtcacatgggcaaccccagccaggttgattcacagttagccaagcacataggagaaggattgggtcggggctgaattctggagacaaatttcctccttaacacattggcccatgggagaagaggaaaaggttggtatatccgtgtgtgcttgcagggctgtggacccagctggggagaggagttatgtgtatggttccagcgtcgccccccataaaaggcacacaaagtaattgccctcataaaaaccaaaaaccttcctactaaaaatcatgaacagcactctgaagcactaaattaatggtgtttggacattgaaaatccaacactgattcagcaacactctcgcttaaaaaatacctttggaatggagcagttggctaccaaggatggggtgtgggagtggctcctcccccgtgcaggcaataaaggggagcattgtctacatattattattcaagttcaatttttatttgagacaattgtagactcacatgcagttgtaagaaataatacagatagaccctgtgcaccctttatgtaccttcctctaatgataacatcttgcaaaagtgtagtacagtatcacaattaggatattaacttgatacagtcaagacatagaacagtcaccacaagggtccctcatgttgcccttttatagccacagccactttcttcctacaccaccttctcctcctcaacccctagaaacaccactcatctgttctgtatttttatcactttatcatttcaagaatgttatttgaatgcagtcatacaattatgtaagcttttggtactggctttttaaaaatctggcatgactgtctggcgattcatccagcttattgtgtgtatgaacagtctatttcttttcattgctgagtagtattccaagggacctggatgaaccacaggttttgtttgtttgtttgttcgagatggagtttcgctctttcacccaggctggagtgaagtggcgtgatctcagctcattgcaatctccgctccccgccgggttcaactgattcttctgcctcagcctcccaaatagctgggattgtaggtacccgccaccatgcccggctaattttaaatttttagtagagacggggtttcgtcatgttggccaggcaggtctcaaactcctgacctcaggtcatccacccgcctcggcctctcaaagtgctaggattacaggtgcgagccatcgcacccggccagcagttgtcttttaaaccattagtctgttgagggacatctgggctgtttccagtacttgcttattaataaagctgcagtgaacattcttgtacaggatttcgtgtgaatataagttgttagttttctaaaataaattcccaggtgtgtgattgctgggttgtttgttagttgtatatttagttctagttgttttttaatgaataggctttattattagaaaaattttggactggtagaaaattgaggagatagtacgtttcccatatactccttttgtcccctgtacaaagttttctctattattatcctctgctagtatgctacatttttcacaattaatgaactagtatcgttattgatacattgtttttaactaaagtccgtagtttacatgaaggttcactctttgtgttgcaaggatctttgggttttgacaaatgcataatattgtgtatccaccattacagtttcaccacccaatgaatatgtgtgcttcacctatttatccctcccttgctgcctccaaaactctggtaaccactgatctttgtaactgtctctccagcttgccttttctagaaagtcatgcagttggaatcacacaatatgttgtcctctcagaccggcttcttcactaggttcctccgtgggttttttgtttgtttgtttatttgtttgtttttatcgttgttgtttacagacagtgtcttgctctgtcacccaggttggagtgcagtggtaccatcacagctcactgtccataataaaccttgaactcctgggctcaagaaatccttctgcctcagcctcctgagtagctgtgactacaggcacacaccaccacgctcaactattttcttaaatttttgtacagacagggtctcagtatattgctcaggctggtcttgaattcctggccacaaacgatccttccaccttggtatcccaaagtgctgggattccaggtgtgactcatcgtacccgacctgacttatttttattgataacatttcattgtctgtaagtaccaccgtttattaattcattcacgtattgagcacctcttggttgcttccaatttttggcaactatgaataaaggaatttccactaaaggaaaacgcttgctcacaagtagagatagaatccaggcaaaaatctagtccactactagttcatgcagctccagaggcaaagaggaaatgcggtttgtggacaagttactgttggaagaatgatggtttttgatgacagctgcaaggtacacaagcccattctgtgataatagctcaaatgaatgcatcactttgttagcttccagctgcagatgctgagccacagcttctataacccccacccagaaacctgctccccagagctcttctgtaaagctgctggctccaggcatgtccctcatgcttcagggtgtggaggccctccagggctggctacaccggggtcctgagttggcctaagcttgtggaggaccagagaggttgtgccaggcagaggcttaatatcacctttcaaaattaaacaagaaaatatctttttattggaaatttctggtttctggtctggcatataaggagcttagaagtcatcactctcatcctcacaacaagaacagaaactgagcaaagcagaaatcagtaactcttctcagattcatcggagaactaaggtcacagagcaaagcagtgcccccaaaactggagagctagacaggtggatacagagaatcacagcttactgaagcagaagcccagaaacagaaatcacttttggagccagtaatggtgcagaaaacttaaactgtaactgatgaactgctggaggctcagtgtggacaaacttgagagttaaagtcttcaaggttgcccagtcttaggttgttgggttttttcaaactttattgatgtataatttacaaaccacaaaattcacccatttgaaatgtacaaatcaatgattttttactagagttactaggtcatgcaaccatcaccacagtcctagttttagaacatttccatcacacaataagattcctatgcccacttatagttaattcacgtgcccagcccactccatggcaacaactaatccactttctttctatctttaatgatttgcctttactggaaatttcatataaaaggaattatatcacatggcttatttgtttaatccatgctgtaccatgtacctgtagccctttcctttttactgttgaacagcattgcaaagatgcagcatatgttgcttatccatctactagttgatggacatttggattgttgtaacttttcagttactgtgaatatgcttcgatgaacattcctgtacaagtctttgtatggacgtatgtttccttttttttttttttttttttaatagagtcttgctctgttgctcaggctggagtgcagtggtgcaaacatggctcactgcagcctcaacctcaacctcccagattcaatggatcctcccacctctgcctcccaaggagctgggactacaggcgcgtgtcacaatgctgggttaatttttgtatttttagtaaaaaggaggcttcaccatgtgcctcaggttggtctcgaattcctgggctcaagcgatctgcctcagcctcccaagtgctgggattgcaggcatgagccaccaaatctggcccactttcttaattgtgacttttccagtaaaaaaagttttaaattttgatgaagtacaatttgttgattttttttcaaaagtgtgctttgctgatgttaataaaactttgcctaagccaaggtaatgaagattttctcctatgagttaatttttctaaggtctgctataaaggtgcaaattcatatttttgcaggtggatattcaattttcccagtgccattcgttgaaaagactattccttcccccgtggaattaatatgttagcacctttgttaaaaatcagttgatcacaaggatatgtgggcttatttatagacttttaattctgttacattgatctgtatgtctactcctataccaaaaccatacagtcatgattactatatcttgaatcggcaagtaaatgttctccagcttttttttttttttttccaaaatgcgtgtggctattctgggtcttttgcactttaatataaattctagaactagctagtcaagttcgacacaaagatctgctggaatttttataggtatcatgtagaatctacacatcattttggaaagaactgacatcttaacaatattgcatctcctgactcatgaacacagtgcatgcatctctctcattcagattcccttgcactcctctcaagaatgttgtttagtttttagtgtataagctgtgcactcattttgttagatttcttcctaagtattttattcttaatgcaattattttcttaatttcactttgggtttattcattgttagtatatagaaatgctactaatttttgtactgaccttgtatcttgtgaacttgctaaactcattgaatagttctaatactttttggtgggtttgttagaattttctgcatacaggatcatgtcaatgaataaaatcaattgcactttctttcttccaagttgggttaacattaacaattcagagttcactgactgcactcactcctgcatgacacggggtctctatcctcttgtaaacatgactcagttgttttttttgttttgttttgttttgttttgttttaatttctggagctgccgcatgtgtgttcatgaatagcgctctggtgaaatttatactttctcccctagtccagaccctgggaagccatgggaggtcagggcccacagcatcacctgtggtcagtgaattctggagttggtgctatgcagatgctgtctacagagtctctatttcttgcaatttcaccccaaactggaagctttgggccacctgcccctttgactacggaagtggcacttaaatttcaaaagcaagatggtcacaatgatcataataagcaggaaacttgagtggcaaacagggaatctcatctgcagagaggagcagactctgttaacagaacacagtgcttttagagccaagatagaagaacagacaacaagtatgttgcttaacttatatacccacatgaaatcgaggctcaataagcagtaggctgggtaaactgctccaataaagttttaatccatctcccagtttccagacctgagccaattctcagacacagaatttattaactgaacataacacaatggtagagtcctcttgaggaaaccacctgcaatactatggcaagttgatacaatagtggttttccaagcccagtttccaaaggaacctatgtctattcacctcagtaactgaacactgggaagggggaaaacactcaaacatttcaaggaccgctggacacagaatctgcattgacactgacacctaggacctgaagcttcatcatggccccctgtttgttagagtggaagcaaatgtgggccaggaataaatggagttcttgcctaggtctgacccagagtgcccatttatccagtttccaaatgggaaattgaaatggacttcctcgataatgggcacaaaccctgactgggtccgtggctgttagtagaagagctagcagagtagagaaggccaagtgcacttcctgcaccttggccatgatagtaagtaataaacaatattgcatcctgagggatggaaaatgttaatgacacccttaatacctaaaggatgtaggggtggtgatccccatcatatcttaatttaaggtagcagcctggctcctacaagaacctgatgggtcactgggactactgcaactttgcactactgcaagctcaatggcaagagcctttaacagatttgttatcttcactagaacagatcaccacggcctcaggcacatggcatgtcgctactgatcatcatgagctaggttctgtcagacccacaaagtcaggtgattccaaaagtaatctgtgataagatagaagtagcatatccaggaccagataccaccacggccatagattacaagcaggtgacctaatccccaatgtcatctgccactgttgtgtctgtgtctctccttcagctcttttttattcctatagattaatggaccaggaagttctcttatgaccagctgctggaggagtagaagtgctgagcttagataatagatggtttggccggatttagagcgcaacctgaaaatgaacttctgttgtaatactacctcaatcgtatgtggtcaagaaatacattgttgagcagaaatccccaggtggcagagcttcaaatggtgcatctgatgatccacttcatatctaaaaaagaagtgacccaaactacgaatggacttatggacagtgaaaaataaattggacagctgctcagggacttagaatgagaagtagtgacagattgcaataagcaggattggggacggaggtttattgatggacgtatgagaagggacactatatgtgaagatatttgtatcacgtcttaaggctcaagagagcattcaccatggaagagacactaaacgtttaatcaagaaaaaaatgacctaactagttgacattagccagcctcagtcgctggccacattaatgctacacaatggccttatgtgtgcaatagccacggtggaagaagtggatgctatgcatgtgttcaacagcatgggtccccattcacccaggcatatccagctatttttgccaaatgttcaaactgccagcaacagaggccagtgctgaatacccagtagggcaccattacttaaggagactaatcagccccttgtggcttgttgattgcgtccagcaaattccatcctggaaggagcagagattcatctttactggaatttgtacacattacaggtataagtttgactttcctgctcacatttctttgtcgggcaccactaacacagggcttaaagaatgttggatacactgagccaggatactccatacgatcagctgggaccaagggacccacatatagcaaaggaagtgctcagtgggcacatgaccgtatgatctaaagttgttatctcatactgcgccacccaaaagccactggtctactggaataatggagtggcttcttcacagtgcaaatgaggtgcaaatttggagatcacagccttgaggatggggtgtcattctctactgtactgtatataccctaaatctattaccattctcttccatcaatagatagaatacatgatgcagataccaaagggtggaatgacctcacttactgtcactccctgtgacctgtatgggaatttgtactttctgctacatgagtttaggttctgtagttctagaactgtgctttccaataaggtgtcactagccacatttagctatttgcacataagtttacactatttaaaattaaatttaaagttcaggtcctcagtcacactaaccaggtttgtatactcaatggtcacatgtggctgctggttaccctattggacagtgctggctagatatattggttcccaaagtaagattacttccacctggaaaaaaacaatttaatgggactctttccattaaatttcaagctattgctcccatctgcgcactttgagcttctcatgctataggaccagcaagcataaaaaggagttgccatgcttgcagggatattggctctgatcatcaggaggaggtagggctgcccttatacaatgggaacagagaggaatgtttggctctcgagtgaccccttgaatgtgtcttcgtagtcccctgccagatttctatagtatagggacaattgtaagtgccacagcctgagaaggtcgtggaggaccaggagcccagaaccttccgggatgagggtttgcactactctattgggtaagtaatagagaacagcaaagattctggttgaaaccgacagtactctagaatggatagtagacaaggaacagaattatcatcagttgtggcttagaggccagctgccacagagggcctatcgtttgtacactcttctttctcatgtgaacttctttagtaagggatcaccagaatccttgaggagttgtgctcaaatgaggtgaactttctacatgaaaaagtagggttaatccactgcttggcatatacccaaaagaaaggaaatcaggatatcgaagagatatctgcactcccatgtttgttgcagcactggtcacaaaacccaagatttggaaacaacctaagcatccatccacagatgaatggaataagaaaatgtgatacatatacgcaatggagtactattcagcaataataaagaatgagatcctgtcattcacaacaacaaggtggaactggagggcattatgttaagtggaataagccaggcacagaaagacaaactttgcatattctcactgatttgtgggagccaaaaatggcaacaattgaactcatagagacagagtagaaggatggttaacagagtctgagaagggtagtggagtggggggggggggaaggatgtttaatgagtacaaaaatatagttagattgaatgaatctaatatttgatcatacaacagggtgactacaatcaaccataatttattgtacattttaataacaaaaaagagtataattgaaatgtgtgtaacacgaagaaaggataaatgcttgaggtgatggatattccatttaccctgatgtgattatgcattgcatgcctgtctcaaaatatcccatgtgccccataagtatatatgcagctactatgtaccgcaaaacattataaataaaaaaaatagaaaaaaatgtaggtttaactgttgcaagagaagatggactgtagtggatggtatagtgctaccaagatctttgctttataactgaggcgctcattcccccaaaggtattgtttgttgatgaccgataaccagggtcctctccatggacggccctcagttgtaggaaacttcctttccggggtcagcttccttctagtgactagtcaaggaatcaatgggaggagtacgaagcccccatccccctgcttcgtatggggttacttcttcaaggctatcctggttgctttctgttttcaaaaattactgtaactactgtgctccgaaatgacagcagaatgaagtggaagttagaccctgagatatcaccactattggaggcttaagccatgggcaggggccatccctgtccgctgtcgggaactctaaaaatagactcctcaggaatttgacttgggctcaatcaaaagccagaatctcaagcctactgtgtcctgttacttgtttcagcaaatgagataacctctgtggcccactgaataaactgtaaagtactagtgagaggatgctattattgctgtcacagcaatagttctgcatcccacagtaagccagtgtggtggataagaactgagctttgaaatcaaaacacctgttatttgagagctccactgaaaaaatgcctgtgacccaccccgggctgcccagcactgcacaatgatggcagaagccattcaggatgtgaaggggcttcaccaggactggacactaggaggctgcagaaagtaagaacatttgacagatgcaacagcaccctctggagcacccgaggatcaggggaagccttaaggacgaggataactgtacacagttgacagatcatttactgtgccaggcagtgggataagtgcttcaagttcctcacagccccgtggaggacaagtttcggccatattttaccaaccttccacgagctgtcttactggatcctgaagccgcacacacaccagtgactactgaggtcaggagttgctgatttaataaacactcccatgacacttactatgtaccaggcattgtttatgtgcttgacagatattacctgatgcagtccttatatgtgcttcgtgaagtacatgctactgctattcatgtttgacagatgagggaactgagatacaaggagtttggaagctcgcccatgatcacacaactaggaagtggcagcgccaagactcatatccaggctggctgggtccagagcccctgcttccagctgtgtcccttaaacctaagtccggctaaactattctcacttggaaacaaacatgtttctaattgtacatttgtgtcctacacacaccttggctcttctgaaaccatgcagaaagaatctactaacccagccacatacccctattagatcgtgagcacctcaaagcaaggtttgaatgccatgtttggaactactggtgcccgtgataagccttagcgcccactgggagatcatgatatatttattaaataatggtttattgaaaaatcaaataatcttcttggatcaactttatctggcttccaacacatgcaacaggcttgggccctggtatgtcagcatgtaaggatacgggtgaggatgttggatcctggaaatgactcctgaaaaggccgtgcatgtgggagatggggaggtacctgggatgtccttaactgcctagggcaccactctccacacccactggctccctccaagaagggacatgtgatgtcgctgtttccggtaatgtcctgttccatcctggagcgcccacaggggtctgacccaggccattcctgggagcacccacctaatgacctggtccagggttccagctcacctcagcctccttctgctcccatgtccctctccccacagccggcccagggcagtacagctggacctggcaggtgcttctcctcacgcccctcctggggtggctgatgctcagcacagcctaatccctcaggaccccaaagccctctcacacccagctgctttccaagtcctaacgtggatctgggagtattctgcggactgcggagtgtcccgatactcaacgcccccaccatctgctacagcctttagtcttctttagctgcctgtctggggataccgaggccctagctgcctctgctaggacaccccagccccacctctctggatcatcagcctgagaaagcaaaacctcatagtcacccatttaaggtgatcggttaatcaaaagccagacattacctggggaattatttgaataatatctcctaatcatcgtgatttgtcactcatcatgtcagaatgcttattattcactaggagcctccccaaaaggcttcatcatctcctgccagttctgtcaccacaagaccttggaaggagatccttaccagggaatttatcacaatgataatcgcatatgagcatcagctccaggtcttgagcagtagttagtggggagagaggaagcgcaaagccccaagctgggcagactgaggcccgattggggcagtgtggacacagcagcaggggacatgagaacacaactatgggccccaggagaaggaaacttgcaatcccaacaagggcatttgactgctggctgccagcctccaattcaaggacacatcgtggctcttaaaatactgatgggtcatgcttcagggcccaaagggtgcagatggcaatgcaggaattcctgcagtcagcttcctacggggtgttgcttcctgtgaagacctccatccctgcccagggccttcaaagtacagaatctggcatctcgcatagaagggagcaaatgtgtatgacttaagtctctggatgtgttctcaggatgtgagaatgaaacccaaagctcccgagtctccttctatggaatctgcctcacatagcttcatgagccccagcttcttgcctgccatcccctgaggacctggtgccagttccccatctgtgtcactcctctcctcacctgaccagatcctgtcacatggctaaaggaaggggaagagaatgcttcatctcagaaggagggtgagtagtgtgctcttcccatggaggtcatgtcattcttgtgcagcctcaaactcctgcactgctcccctgacctctccctggagggttctgcccactccacagtccctcctgctgtgctcccaaaccccagtgtgtatctccagaacatgtctgcaaggacctaggcctccaacatactcttccttcttccccatcttggcatcaaatctgtcttggaggactctaggaatactagtctgatttttgtagaacatccctcagtttcagtgggtctaatgtcttctcacgattagaagggcatgcatgattatgcattattaggaagaacaccacggaggtgggaagccctttttatagtgaatacagtatctccagcacttaggtcagtgcctggagcatatgaggagctggataaatattgaatgaatgagcgaatgaaatcatgttatgttacctcttggagagtgtgtaatgattcctcaaataacttcacgcagcaaggaacggtgtgtacaaaggcagggatggcacctgtctactggcattggggagaaatcatgatggagcattctccagatgaatgcaaccttgcaaaccacgttggccacccttcctactttctccagggaagtagcatcaaagtcattggcgaacatgggacttctgtctagagcttgtccaggaatcaatgggaaagtgttacttgaactgaatgttacataaatccctttaaggcccagctgaaacccagagacatgtgagaccttgacattggctgcttgcagacccaaacgaccagagagaggagcagggaattgggacaagggccacagctgcctactggcaagagagagtgctcagatagccactgatgtttgtagccctgccttgctgacttccccaggatgccaggagcacagaccaggcgctggggcagcaggtctctggagtccctagagctcagttgcttacctgttccatgactcaacaataagagggtgctgggatgcatttaaactttgattgctgggtaattgggaggactgaaaatgccacgaggctccaatgcagaggctgcgaatactaggaccatggagctgtagttcttcatgcgtcccacagctgagtactgagcatgtactgtttgccaggcactgctctaagctctgaggatacagcattgaacaaattccctgcttctgtggagcttatgttctagcgggaggggaggggcaggcacacaatgaactgcggaacaaagttacaggtgaagtaggttttatggtgacaaacgctatggaaacaaattgaatcgagagagctaaataaggagtgctggaaattgggtggaaggagggattgcaatttttacaatggtattcatagaaggcctcacagaagagatatctcgagagagaaccgaggatgtctgggaaggaatgctaacagtattataagagcaatcgtctagaagagaacaaagacatgcagtcgctcggggccttggaacagagtgtagagggcagggtctagagacactggtctggtgagccaggtaaagggtattccctgatcctctgagccatggactgcctcagagccaggtcagctgcactgtaccatgaactggcttcttggatccaggtttctattccaggttactgacttgacctgaggactgggtacagaatacaggtctaggtgtccagaaacctttctctcgggataaaggggatggaaggcaccattggcattgaacaggcaaggctgttggcctgctgctgtggcactgctgcggcgggcaggacaatggtgcacgtgtaaagactgggtgcagaacaaagcagaaggctgtctggtgacacctagtgctcattccagagtagactctgtgtcttcaatgaggggccagatgtcttaatccaggactggatttcctatctttcaaagttcacctcaggtggaggccagaagcaggtttggctttttgttgggggggaaggtacacataggaggctctttgtgcttcctactgtactccagcaggaggcatacaacttctggctgttcaacccttgatcatattggctctgatcagtgggctcaggtggagaggtggagacagccttgttcctccattgcagagtgcgtcatcaacccttcaacaatgtttcatccattgattagcatggattgcatcagttgcattgctggatattgcaaatacttgttttccttttctctcatatgttgcattttcctcagctggaattctccagtaaggaagaaactttcctcatcaactgtagctattgtgtcatcctgaaatacagttagtacaggaaatgcaggataaatgttttattctctctcttgcagagccaattctcaatgtgaggggtggttattcttgttccttccaatggggtccaacaagtcattctttattaatgactttttattttagaaaatgtttaggcttacagaattattgcagagatagtacagagaattctcatataccccacacccagttttccctattaccatcctcttatattagcattacacatttgccacaattaataaaacggaagacaaaaacaaggacactagaggaatctgaagcctctggcatctataggtataagaaataaagcccaactcccagccaaattgacatacatcctcactgtagagatctaattgcctctgttcctatgacctcatacaacacgttcactctcaacaaaaggattgcaagggacacacgcaaaagagtaagaaaatacatagtctgaagagacaagacaatcaacagaactggactctaatatgactcagatattggaattaggaggcagataatttaaaatgactatttttaaaaatttaagaggctttaatggaaaaagtaggcaacatggaaaaacagataggtaatgcaggaagagaagtattgcgctcagcaaaatccagagtatgggaaactggacagaacacaaggcatgtcttcattttcaacaaatgagtttcaaaaaaaggtaatgtgggggaatctataaattacttaaggtggctattaagaacataaacacaatgtatagatcatatttgcaaaccgattcaaagaaactgcattttaacaggagcatatgtccaccagatacatgtgacaaataagtgaacatttcattatattaatgacttgcttacatgtttaggaaagataataatgttggctttatgttttataagagagtagttatctttagaaatgcactctgatgtatttggagatgagatcacatggtgtcttggatttgctccacattatttcagtttctgctatgcggagtaggtaggggtataactagaaccagattggccatgagttgaagattattgatactgaaagtctggtatattagattaattatagtatttaccctattattaggtgtatttgaaaatgcttgtaatgaaaatatttttgaaataaatatgatatttaatttgaaatcctaagtgaaatggataatattttaggaaaataagtacatgaacaaattgatacaaaaagaaattcaaatctttaaccaaacaataaaaagtgaaactaatctaagctcaagccatcctcaaatgtggacaaggcagcttcggaggccaattctacattgttatcaggtaaagctcaaagccaccttaagtaaactcttccaaggcatacgaaaagttgggcaattattcaaattattttcccaagctaaccattcttcattcaggtaccagaggaggacagcaccgtgaaaacacttgagccaaacttcactcacacagaggcaaatatattaattaaattagtagcatattcaacatagaagtgaattaacggattgtgtccaaggaacaaaaacatgatttaatataaaacaattttcagttgtgatttcctacgttatcgaattaagattttaaaaagtgatcactttagtagatataaaaaagcttctggatgaaattctatacaagttaatggtcaaaacatttagcaaaataagtttagcagcatattttcttttcctgagatcaatggacaacatacttaagtatgaaatgttagaagaattcttgtcatggacataggctataacctctatctttggaaactgcatgtaacataaggcaggagatatggatatcaaaagaaatcagtatgaatattgaacagaaagagttaatatttggtatgacaatatgattatctagaaaattcaaagaaatgtgcacatggaatagtcaaataacagacttcagaataatagtatacaggttactacagtaaaatcaaaatccttgcaacccaatgaaataaccactcagaacaagtaatagaaaataccccattcacaatggcaacaaaatccagaaattgtctaataagacagacaaaccatacaagatctttatggaaacaactatgcaaatactgatagattcgggtcaaaaacttcccagataaatagagccatattccatatcccttaatagggaacaggctattgaaaagatgtcaatttttctttatccaagatgtacagatataacgcttaaaatttagctggcaatatgaacgtcaagcttgggcttctgtccttcactcccaaaacgaaccctggaaaactatagaaggaagaataaaataacaaacaaacagtataaacaacaaaatctaaacaacaaaacatgagaaagctctgagggagaatgaagactgtatttaactggtacctgtaatcgaagtggccagagtgtcaaggaagttagggagagtccatagctggcatagaaggaagatgacaggatgtgtagaaggaaatgtttaaatttttgcccctattccagtgtgaaaatgtcaggtggcacctgagaccacaggtgccagtagtctggtttcattgaaacagtagtagctccagtctgtgctaataaccacctaaaaccacattaataggtgaattggcttaactgaacataaagaatggattacaaatagagtgttgagcattagaatgaaacaggcataatgaggttaagtatgatttctgatgctgaatgaaagtttaaaaatgaaaatcactgcactgagctatgaaatgttagataattccaatggcagaactccttagatttctagctgctggtcagcctactcaatgtaaaaataaatattttagggtaaaaggtttgcaaattcaacctctggctggggaagagctgccctgggaaggtgcgtgtcttctcccagaggccactacaatcacagctcctgcagcccccccacggagcacctggcctgggacccgcagccattctctgcaaggggtgcagctgggcaaaggctcagaggtgacagaaacagagtatctgccacccatcactgcatcgaaagagccaggagtcaggaggaggatcctcctgagtgaggactgaaggtccaccctccccacatagaggggccacagaatccaactcagcccctcccgtcattccctggaagaccctggcaatgttgtcgtcccgaccacacccctctcccgactgccacctcatgggactcagagtcagagacttggtctgaggggagcagagaatgggggtccaggatctgccagccatcaaggtcaggaccccgagggatgactgagggtcctccacccccattcccaaacccaccaccaccaagacctaagccctgggggtcccaccccaatccctccccctaccgcccccaattcctccccctaaacccccgcaccccacatcttaacaaccacccccacccaaatccaggcagaacccgtttctgcccatgctgtcaacccagggaagccccaggttggggcttctaaggttattcttcaccttagaacaaatatctggacaggccccacaccactggacccctagaaattttactgaggtagggccgggcacagtggctcacgcctgtaatcccagcactttgggaggccgaggcaggcggatcacgaggtcaggagatcgagaccatcctggctaacacggtgaaaccccacctctactaaaaaatataaaaaattagccaggcgtgatggcggatgcctgtagtcccagttacttgggaggctgaggcaggagaatggcgtgaacccaggaggtggagcttgcagtgagcggagatcgcgccactgcactccagtctgggagacagagcaagactctgtctcaaaaaaaaaaaaaaaaaaaaaaaaaggaagaaattttactgaggtagaaggtccctgaattttagtcggatttatttcccatcctctggcatgcaaatgtctcactactaagtccagtgtgttttctacttcttgctcactggatccaattagcataatgtcattaatgtaatggaccagtgtgatatcttgcagaagcaaaaagccatcaaggtctctctgaataagattatgacacaaacctggagagctgatatacccctgagataggacagtagaggtatattgctggccttgccagctgaaggcaaattgcttccagtgggccttatggacaggaacagggaaaaaggcatttagcaagtcaatggctgcataccagataccaggagatgtgttaatttctcaagcaatgaaaccacatctggtacagcagttgcaattggagttaccacttggttaagcttacgataatccactgtcattctccaagatccatctgtcttctgcacaggccaaatgggagagttgaatgggtatgtggtgggaatcaccacccctgcatgtttcaagtccgtaatctccgcaatccctccatggatgcaatattgtttttgatttactatttttctaggtagagacagctctaatgtcttccatttggcctgtcccaccataatagccctcaccctaccagtcagcgagccaatgtgggggttgtgccagctgctaagtatgtctatgccaattatgcattctggcactggtgaaatgtccacaggatgagtctggggacccactgggcccactgtaagtcagacctgagctaaaactccattaattacctgacctccataagcccctactttaactggaggatcacaatgacattttgggtcgcctggaatcagcgtcagctcagagccagtgtccagtagtccctgaaatgtctgattgttgtcctttccccaatgcacagttattctggtaaaaggcaggaggtcttcttggggaaggataggagaaagattcactgcataaattgtcggtaatgtagtggggtccttccttaaggggacccagcctccacttcattcaaggtgttctgggtctgtaaactggctcatgtctagaaactgatagaggggtcgtgattctctgtttttataattcaaattagtcttttgacaattctaactagaagttttctgcttgtataaattaagtaggaatgcgtaggctttctaccaacttcacttctgggaacaccatgatttattagccagtgccatagggctacacaagtaagattattctgattgccgctttgcctttgctgtccattatggtagtagctatgcccaccttgcctttggcggtttagtgctgccacttggcccctgccacctcgggatccaattatacccattgtatttaaattttgtagtttagttactgcacttcccaccattagatctgacatacagaaaagagcaattacaagtctcttcaaagatgtaggtgctgccttcacaaatctatttcacaagtcagtcttcaagggcatatcttctggaccctcccagctgggatgagtaggtctaacatgactaatacactccaccatcccaatctccattagcctttggatcccttcctctacattaaaccaaggtagatcaggcatttccagctgctcacagtgggccatcttttaatccatatttcagctatccaagcaaataagcaactacaaccttttttaacttcccaagctgcaacattaaaagcagagtatttacttagtgggcccaaatcaataaattctgcctgacccaactctatgttccttccatcattatctcatgccattaatatccattctcatgcctgttctccagatttctctttacagaaattagaaaactcaagcagttcttctcgggtgtagtgcacctcctcgtggatcacactctcaacctcacctccaggggcctgccgggactttagtctagttataggtctagaagtaaaaaggggtgttggggtggcacctgaggagaatcaacattatctcacctggcaactgcctcagaggaggccaccactgttgcctcaagaagcacagggtttatctcctcagacaaaggtggaagggctgatggcagcatgggtcagggagggaatgttgccactactggggatggggaaactgttctggcaaaaaagattcatcagagtttacaaactcagcgtccccagcttcatcagggtccttccacacgtccccattccaagttgcagggtcctattcttttccaatcaatgccctcactttaacagtacccccctggtgaggctgtgcatgcatcttttgttgcaggtcagcaactcacatgataagaccttgggtctgttttcccacaattttagctctttctctacaggagataagactctcactcagggcaatcttagcagatttgaggctcagtatctgcttctgaagccgggagacagaatccctgagttcatcattttctttcatcactttgtccactgaacttaggagcaactaaccagcttcattatgttctttgattcgccgcatatggccaaaggtattatgtatagagtcactaaacttcttgcctctcacaagtgctgaatcacgaatgtcaaatgcatttattttaaataactctctaaacagttcatgtcaaaggctaaaagtgttttccatactattagaagtagagtccttagcgtttttggggtctaatcatattaggcaaccaactccagaaatgcccaaaccaacaaaagaactcaatctttaatattctctttctctagaaccactcctggtaccaaaaatctgtattagtcagggttctctagagggacagaagtaatataggatatatatcatatattttatatatatatacatatataaattatatatttaactagtacctttaatcgaagtggcagagtggcagggaagttatggggggtccagagctggcaaagaaggaagatgacaggatgtgtaggaggaaatgtttaaacttttgctcctattccattgtgaaaatgtcaggcggcacctgagaccacaagtgccagtagtctggtttgattgaagcagtaatagctccagtctgtgctaataaccacctaaaaccacattaataggtgaattggcttaattgaacataaagaatggattacaaatagagtgttgagcattagaatgaaacaggcataatgaggttaagtatgatttctgatgctgaatgaaagtttaaaaatgaaaatcactgcactgagctatgaaatgttagataattccaatggcagaactccttagatttctagctgctggtcagcctatattatattatatctatatatagatataatagatatatatatatacctattacttctgtaatagatatatatatatatatatattcccccttcccaggacttcttgattttgcttgctctgggttgtaggggtttgttgtttgtttagtgacttttctggactatattttaaagtctacattctttgtcatgtacagacactgccatctcttaatttattagcttagcggccacctagtgatttgatagagattttcttaaatgtatggaattaaaaaaaaaatcccagtatttgtagatgctatgcgtgtgtctgtgttggagcacataatacctcaaaagatgagctagtctatcttcactttggccaatttaagagtttttcatgatgatagcaataccttgaatatccacatagtatcattgtggaaaatagtcatactttatataatagtacattttcacaatgggcaattttatcctggttagccccaagggcagcttgagagaatcacaattgtgatagtcatacttagccatgatgcatcacctttcttctgagaatgaaaaaaaaaaagtcataaatggtaaataagcttcccaacacctactggggaatggatattattatacaagctaattttaaagatgagtaaccgaaatcaagttttcatctgctgaagcattaggaccctgcctcagatgtttgggtccagcttcctttcccatcctctgggtaaagtccaatgtgtagcccagaggtggttctcaatgaacactcaaatacagacgaggaactaaggcacagagaagcttgtgtaacaggtcctgagccaccaagcaagtaagggtggaggagcacagatgcaactcagggtctagctgaacctgcagcccatactgttagaaagaggtgcttgccagtgttcctatcggacagcaacatctttattaccagtgatcatgcccaaagcaggcatgaagggggagatggcttgtcagttcagacacttgaataacaggcaccattgccttttcaagagcttcatagatggaaagcactcaagctcctcagagtctagagccttgagagcagacgctattttagtgagatccagggagtcctggagctgaaccactgctctgcaggcccacaaattcagttttagcagtcctcccagagttgtccaggccccagaggctatctagcaaaagcaacatgacactgacacacaaaccagttgtcaacctcaaggtttcttactattaagtaaaaatttccagacagacaaggagaggaggctgtaatgatctctgcgatagcagatttgagttagagatattaggaagaactcactgttgacttaatattcatgcagatcattgcatctagaaatatttatagatatattaacaggttactatacacacatataatttcttgctctgtcagcagatgccaccaacaccccagtaggaatgagcatacctaatatacagatctagatttctaataccattctccaattttaaaaaatgggctcagtggagaaattgctgatggttgaagcagatcaggaaatatgcagtctattcctggaacatcttattgtgcttgacagtaaagaaatactaaaaaaaaaaaaaaatttaaacacattgacaaatgtataagaaagacatgtacaaagagaactaagagaaagtgctcccagtggccaaacctggagtaattttaacaacagaacatataaagttgtattggattttcaacaaagtgtaaaattagtatccgtaagtccacatcgagataaataaatgattacttaaatgcaaaaatgagggtgaacagacaaatttctcatgggaaagagttccaaacaatttatgcagatactctcactctcacaagaaagcagaatgtgattccccactgctcatagtgtgggctacacagagtaactttcttccaaagagaacactatgaaataggggaataaaagagaaactttacagtaaccatacttcgcgagcactacttcagccaggtgttcaaggtaaacatcattagtaataagtcatgctgataatatgtagccttgatgtgaagtgatgagaatggcatttctcctttattgtcttcttccccagaacccataaccccagcctaatcatgagaaaagtaccagacaaaccacaactgagggtcattctacaaaatacctgaccaatactcctcaaaactgtcaagatcatccaaaacaagagaagtatcacacccaagaggaatctaaagggaccttaccactaaatataatgtggcatcctggatggaatcatggaggaccaaaaggacactaggtaaaaatgaaataaatctcaataaagagtgacctttagttagtaacacgtaacgcaacaattgtagcaaatgtaccatactcatgtaggatgttaacaataggggaacctgaaactgaaggaggaggcatatagaaactttgtactatctttgaaaattattttcaagcatagaatacctcaaaataaataaagtctatgaaattttaaaaatggaggtaacaaaaggaaactttgcagactgatgaatttaatttttataaaagaaaccatacacaagcacagagaactaggaaatgtgacgccaaccatttctgagttgtcctcagacctttcctcccctgaagcctctaagctggactcgcccacaagacccgcctcttccccctgtgcgatacctcggaaatccatccctcatctccagcctttcaaccactgccctaatttggcctcacaattcctctcacttggactgtgaccagagccccctaataaggctagatgctctgggaccccatacttgctcaagaagggctatagaacacttaccaggggtaattgccacagagaaaggctggcaagagccaggcaggagatcagccccttgtcaaggaggctggagttcagagtagggggtttagccatggctggtggaacagggaggtttctcagggaagtgagaccatggctgagaggtctctcaccagcccctcagggggcaggtttggggcacctggaaaccctcaagacctatccacggatgggcacaggtatgctcccatctgctctgccctgtgatgttcagaattgtcccagtcctgtgtgatgtgtgtccatacaggaggctgctgtggaggatgctggaccctgaaatgcctgtaggagaggatgtggggtgcatggaacgtcctagctgctgcagccctgcagtccttaggaaacacagggtgagcattctccatatccctttgctctgtccaataagggacatgtggtgttgctgtttccaccaatgtcccctgtggggtccaagggcccaccctgagaccagcaagatgcaagttcttgagtacatagccaacgccaatgggagggatcccacttcttacccatccctctgcggacctgagtctccatccctcagattcccaacgccgaatgaggaggcacctcagtctaagatgggggcggggtgggccccctgtcctggggtgctgggtcccctcaggcctctctcatctcccaggaactcatagcatgcaggatcactgccaggcacttgccggtacaccaggtacttttcctgcacccaatcttgggtgaggagcttcttgggctccccaaagaggaagtgctcccttccagcatacacccccataatgctgaggacttcccacataacctccatgggacgcagttcccctccatgaagatcacacccaggactattatcaggaggccagacttgggcatgctctgctcatcacccagtatgccatcataagagaggccgagggaaacagaggaagctgggatttgtgagatccctttttcttggcatgtgagagggtaccttcttaccttcagtcttcaccaatattcctctccttgactactggtgagaggtgacagcatgctggcagccctcacagcccttgctcactctcggcgcctcctctgcctgggctcccactttggcagcacttgaggagcccttcagcccactattgcactgtgggagccccttcctgggctggcggaggctccctcagcttgcggggaggtgtggagggagaggcgcaggcgggaaccggggctgcgctcggtgcttgcgggccagcacgacttccgggtgggtgtgggctgggcaggcccgcactcagagcggccggctggccccccctgcccggggcagtgaggggcttagcacctgggccagcagctgctgtgctcaatttcttgccgggccttagctgccttcccgcggggcagggctcgggaccagcagcccaccatgcctgagcctccccctcgctccgtgggctcctgtgctgcccgagcctcctggacgagcgccactccctgctccacggcacccagtcccatcgaccacccaagggctgaggaatgccggcgcacggcgcgggactggcaggcagctccacctgtggccctggtgcccgatccactgggtgaagccagctgggctcctgagtctggtggggacttggagaacctttatgtctagctaagggattgtaaatacaccaatcggcactctgtatctagctcaaggtttgtaaacacaccaatcagcaccctgtgtctagctcagggtttgtgaatgcaccaatggacactctgtatctagctgctctggtggggacttggagaacttttatgtctagctcagggattgtaaatataccaattggcactctgtatctagctcaaggtttgtaaacacaccaatcagcaccctgtgtctagctcaggttttgtgaatgcaccagttgacactctgtatctagctactctggtggggacttggagaacctttgtgtccacactctgtatctagctaatctagtggggaggtggagaacctttgtgtctagctcagggattgcaaaggcaccaatcagcaccctgtcaaaacagaccactgggctctctgtaaaatggaccaattagcaggatgtgggtggggccagataagagaataaaagcaggctgctccagccagcagtggcaacccactcaggtcccctttcgcactgtggaagctttgttcttttgctctttgtaataaatcttgctgctgctcatcctttgggtccacactgcctttatgagctgtaacactcaccgcgaactcaccgcgaaggtctgcagcttcactcctaaagccagcgagaccacaaacccaccaggaggaacgaacaactccagacgcgccaccttaagagctgtaacactcaccgcgaaggtccgcagcttcactcctgagccggcgagaccacgaaccccaccagaaggaagaaactccgaacatcagaaggaacaaactctggacacgccgcccttaagaactgtaacactcaccgtgagggtccacggcttcattcttgaagtgagtgagaccaagaacccaccaattccggacccactggcagatcctggactccaccctgtgctgagcaggtgtctatccctctgctgacctgacaacctgcctcagaccaagggccctacctctctgagatgtgggaggcacaaagtgaaggggcactacacggacagccctgcatggcatgccaaaggctgacagatggagcagatttcagggtgcctgctctctctgggtgtcctccaggtattcagatttactcatgacaatgcctgcccctttcccttcatcccctggaggccccaggtaggggaggtatgtgccatgctcacatttctgccaggtggttgggggtgggaggtttcatggaggtgagcatctggttccaagggggtgatgataggtaggtcagcagtggagccacaattggtcagcagaggaaggagtcccaggatctttaggactcaagatgtgaacccctcgtgaggactggagatacccccatcccataatgaagggatcccacagagtctctctgtcccctgtccttgtctctttggagacctgatcatgggtggctctaagtggcaaggtcacttgtaccacaggcaggaagttggggaatcttcagggagattccctgaagattggtgtaaagggaagtcttggtgtaaagggatatgtttgctcatctcaggggttgggagtagaggaaggacaggctctggcagaagtaaagatgaaaaacccacaggaggactttggaatccccagaacagaagggtccagcctctgctgtcagccctggacaaccacatgatggggtgatgggacgtggggccccttacttctgttttggaatcttgggcaggtgagcactatgttctcagaggacgacttccagtcaacagaaagagccccgtatggtccacaactacagtggtcccaggatctgccaagagtccaggtgagaaacctgagggaggattgagggttcctcctggccagaacacagatggctgcttagaaatctgctctgcccctgctgtctccccagagagcatgtgcaggactatctgctgagatccctctcttatactgggatcattggtctcagggagggggaggcattggtctgagagggctgcacttaggtcagcagtgggagggtcccaggccatgaccagaatcaaggtgagggctgacgggacagcacttaccaaaaacatgggactcagcccttccctgccccttctgtcagccatgcgaagtccccgggaaccatgggtgtttccacttccctgatctcctcttctgatgtctcctggagatagagctttggtttaaggagatggccttaggtcaaaagagggagggtcccaggcccagatacacaccaaagatggggaccaaacaggctccttaccccagcacacatggacccagctgactatcaccacctcctgctgtcctttttgggtatccctgaattgtggatgggttttgcaggccaagaccaccatctcccagagaaatccaactaggaagtggggagctgcctctctttcctagagtcctgcctggggcctcccaggactgatggcaggggcaggatttctacctcagggataacttgttgtctgagtcctccctcagtgctctgggacttctcctggggttgacctgaggctccactcctcagaccacaacccactcctctctgacaccccaaaggcagagcgaggatgcaccacatttgggcactgtgccttggaactccaagggccaaggtccccactgaactggagtccaaggcctcctgagtcctccctcttcctcccattgatcctggcagggctgaaccagagatcccctctgcggacctgagtctccatccctcagattcccaacgccgaatgaggaggcacctcagtctaagatgggggcggggtgggccccctgtcctggggtgctgggtcccctcaggcctccctcatctcccagcagggactgggccttatctgtgctccccctaggccattctcatgataccaagcctcttccctcggtcagcccgggatgcggaaatcaggatccacttgcctggcagcaatgccaggaacttcccagggctgacagcagagagggagcctcgctctgtggggcctcagccctccctcggggtcctgaccttgatgcctggcagaacctgggtcctgccccccccaaccagccctgccctggtcacaccaagctctgaccccacagtcccttgaggcttaagcggcagggggcagaagccgaggggggtgtcggaggggacggcccagcctgagaagtccatccccatggggtgatccagggctggcagcagaggcggtgctggattatctggggtcctctatctggggagggagcgtcctcagtcctccctcagcatctcatcttgcctcctcacagagcctgggcccgctgccctcagcggatcacaagccgcccttcagaaccgggctgtcacttctctctgaccccctaatgtgcaagtccgcggtaccaagcccggaggtcctttgcgttgactgcagggacaaggatggactctggggcccctctatcaggatggggtggaacctctccataatttctcagagtcctgatgttgatgtctggaaaggccagggccccaccctttacggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctgggcccgctgccttctgccactctcaagacacccctcagagagatgctctctcttctctcagatcccagaggcagaagccagtggaggtcacatctggcccccatgcctggagcttccctggattgacagcagtggcagtactcgattctgctggggtgggggcagggggaagagtaatggcgaggggtgcagatgtggtcgagggtcatggaggtgcctcaatcctccctcaggtttctgtccttcattctctgcagagcctggagctccgtcctctgccaatggtgtctcctctcctcagaccaagtctctgactctgagtcccctgaagtggcagtgagggggaggtgtcaggtcgggggacaacattgccaaggtcttccagggctgacaggagggaccgagctggattctgtggcccctctatgtggggacggtggaccctcacttctcactcaggagactcttcctcctggctcccagctctttgatgaagtgatgggtgggagatgctctgtttctgtcacctctgagcatttgccaactgcaccccttgcagagaatggccgtgggttccaggctaggtgcttcctgggggtcttcagcacctgtgattttagtgacctctgggagaagacccacaccttcctacaggggcttctccccaaccagagctaaaggctggccctgttggttctgggatgggtgtaccaaagtcctcctgtgggttattcatctttacatctgctggggcctgccattcctcggctcccaatccctgagatgagcagacatttgccctttacaccaagaccccatctccctgtgggttccctaacttcctgcctgtggtacaagtgagcttgacacttagggccacccgtgatcaggtccccatagagccaagaacaggagacaacaagattctatttgctagatcatttttttgtaagactgttgtaagaaatgtattgaattgcctgacacagtgcctggcatatattgaatatttaataaatggtagttttcaaatattatttttagaccacatcttactataacctcctttgggaattacttctgttgttatctaaaatatctcagagaatatgcagctcaatagaacatataatatcaaattagtcaaaattgaagctttgtgaataaaagttagtaaaatttccctccgagatggcctattatttaatttgggcgtataagagtcttccccatctggatgcagctcaaagatcttgaaagttgagtgaaagaccaactcattctctccctcccagctgcttttccatccaaaccactattttcattcaatttactcctatcccaaacctagcccttgattatctgagttctccatttcagaccaaggccttacctccctgaagccccactctcaccccactgcagaagtgagagcatgccacagccagcctcttgccagggtcatcctagggctgacaatcggcaacagccagaatcctggagggcccttcttttctggagtgttgagttccttctaactttattcttacaggctctactcacttccacagttacttatgccagcaccttttctcttgatattcattaaagaggttgtttcatatctttgtaatatatagttattctgttttgtcatattgtccattctttcctgggatattcagacctcctaaattatttttttatatttgcatactttaggggtcacaattgttctgagcattttgacaaatgcatagtgttatattcaccattacagtatcatacaggatagcttcatcaccctaataaatcccctgtgcttaccctattcaatccttccccctcacccacccaacccctggaagcaactgatctttttactgtctctatagttttgccttttccagaatgccaaataaattgtatcatcatacactatctaaacttttcaggctggtttttttcacttagggataggcatttaatatttatccatgtctttgtatggcttgtgatgtggtttggctgtggccccacccaaatctcaacttgaattgtgtctcccagaattcccatgtgttgtgggagggacccaggggggaggtaactaaatcatgggagctggtctttcccatgctattcttgtgatagtgaataagactcaagagatctgacgggtttattaggggtttccacttctgcttcttccttattttgtttctcttgccactgccatataagaagtgcctttcgcctcctgccatgattctgaggcctccccagccatgtggaaccgtaagtccaattaaatctctttttcttcccaggcttaggtgtgtctttatcagcggcatgaaaacagactaatatagcttgacagctcatttctttttattgattaatagtgttctattaaatggttgtaccacagtttgtttatccattcacctactgaagaacaacttagttcaatccattactgacaattataaaataagctatgatacaaatttatatgcaagattttgtgtagaattaaaatttcaaattacttggattaatacctaggggtgtgttctctgaatcacatggtaatactatgttcagctttgtaagaaactcacaaactgtactacaaagtgactgtactatttgcattcccaccagcaatgaatgattctttttgctcagcatccgtgccagcaattgatattgtctgttttttttaactttagacactctaaatatgaaattaatgtagctattccagctttcttttgtcagtgttagaatacctttttcaacctccttacattgaacttatgtgagtccttataattaaaaatgggtttcttatagacaatatgttcttgagtattattttttattaattctgacaacctgtcttttattggtatacttagaccattcaaactgaaagagattattaatataattcattaatatctaccatgcatgtaactgttttctatgtatttaatttttctttattcctcttctttttctgtcttctttcgctttataaaacatttagtacatgtaaaattacaccttttttaaaaaaattagtctttgtcttagagtttataatatatattttaataacatgccataaaacaacactatactgcttcatatgtactatagataccttataaaagagtatactcagttccttcattgcattgcttgtaacattacaatcatttatttcatttatccatatacactagttgtctgatacattgttactattattaacttaaataaatagttaccttttaggtcagttaagaataagaaagcattttattttacctttatttatttcttctctggtattctttctttatctagacctaaacttaggacctatataagattcctataattgatagagaaaagtagaaaatcagtaagagcaaagaagatctaatgaccattaaatgcagagtatcatttgaaaatttcaacacattttattttaaaaaattctcagcaaattaaaaatatatgtgagcattatcaattcattaaaggaaatctacaaaaaaactagagctaagaatatgcttaatgatgaaatactgaatgttttccatctaaggtcaggatcaaggcaaaaataacggatttcatacttctcctcaactttttctattagaggttcaaactattgcaatagagcaagagaaagaaatgaaaaacatgattcaaaaggaagaaatacaatggtctttactgcaaacaacatgatggtcagtgtggaaaatcctaaggattctacaaagaaaaaaggaaaactgcaattaataagtgaatataccacggttataagatacacatttaatacaaagaaattaatactatagctctatactaacagcaaacacatgaaaatgacaaaaagcaagtgctttatgaatagcaaaacataaaatactttggaatacatttaatgaaaagtttgtaagacctgtacactgaaaactacaaaatatgacagaaaaatttgaaaacatctaaataaatgaagagataatccatgctcatacctgagaaaaatctaaattgttgttttattctattgcttataattcagtactaccattatttatattgttgctcaaattttccagcttttgggagcccttttagtctttggaagctcctgtaccctttttatatactgcatcatttcttaagcacgtctttattttcctgcaccacaaaatgcgaagctcaccttgtattttctatgccccagtcctagaaccaaataaataaataaatttggacttcctcaaaaataaaataaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcgtgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctcctgcatcccgatctttgtccccctttggctctcgttgatcacgctgatggcaaccacatttggacagaagggaggaaaccactgtatgtactcagcatttcagaagtccttggtgtgtgtctggggggggaccagggggtggggggtggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagtagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttcgccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctaccgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacccgtgcatgatgtgtatcttctttgctggatgggccaggaaactggagtggtcctctcagccagcctcagaggaaagaaatctctagctggcacaggcagccagtgagtgaggctggcggctgcaggggcacagcctttagaatgagtccttcagtgcacaggtcccagggtatacggggtagtgggaggaaggaggggacgcctcgcagatgccactgttggctgggctacaccttgccacacttgttactgcttaggaggctttctggagtgttccttgggtgctacgacaatctgcagcagacactgtcctttcaccgctcctggtcctcgtttgctccccagtgatgtcaacagctgaggactgctcacgctgcaacaaaaggctctgcagtcgctgtctagcttgccctagtcgtctctagagttctgcctgaactgaaactcaagtggggttcagctcatgacttgtggcaattgaccaggaaattcaccagttgctgtggctggaaggattttcagtcctgtgggttgtaaccagaggccacaggtggattctgccttaggctcatgagatttccgacttgctgttgaagaaaatgccttgtgaagtgacaacagtagctctgacccaactgccggtgcctcgctagttcctatacgtcccactggatcctcacagccccgggaagcaggtgctactactcttatccccgggaggagacagaggccgagagaggttaagtgacgtgcccaagtcacacagctcggcagcggccgggttgagcatcagcagtctgtttgcagacccctcactgtcaccccctgagccagtgcgccttgggccctgcggtcaggatgtctcaagcgtggaggcatcaccggttcgtggcagtctctggaaggtcactgagctctgtgcccagaatcgagtcgggggagtctgtgcagaggtggccctgtgtgtggggacagtgtgtgacacagacactgctttggatggacacctctcccgtgacctcctagcatccaatcccaaaggaacaactgttgcagagatggaccgctggacacaaacccacgtgcgtttctctggagacactggccaaggaaaacaaaacatgctcgaaggccaacagctgcatgccccaccgcgatgtgaccgcagacacccggggtgtagaagggtctctgcctggtggggggacacgtgcaggccgaggagaggcaggaaggaggctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggcgttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtcttcatggtctccatcctttttctttctttgcagtccagtaccccgctccgacatctttggcttgcatgatagagacttcagcctaacacgcctccctggaaaagtgcccaggagatactcgagcaggtgctgggttttaggaagcccctcagacatcccgcctctactcattaaaaattacctggagctggccgggcgcagtggctcatgcctgtaatcccagcactttgggaggccgaggcgggtggatcacgagctcgggagatcgagactgtcctgactaacacggtgaaaccccgtctgtactaaaaatacaaaaaattagccgggcgtagtggcgggcacctgtagtcccagctactcgggaggctgaggcaggagaatggcatgaacccgggaggcggagcgtgcagcaagccgagatcgcgccactgcactccagcctgggcgacagagcaggactccgtctaaaaaaaaaaaaaaaaaaaaaattacctggagttgctcgctgagtgctaattgtgctgctagcattgccggcctagggttcacaatgactctgtgttactggccattccttgtcatggcggtgcctttatataacaggatcttcactttacatacagatgagatcacgtctggctttgtcattgggttaaaaagtgcccttgatagttgtggaggtgacacatactaccaaggagtcctacgggtttgcagtttagagggtgctcattagtgtctggtggacaggatttatgtttggcttttatgtctgtactggatctggtggggttttttacttccttccttgattcccccactatgcccccactttttctttcttgtttcccttccttcctactttcctttcctctccttttttctctctctctctctttgcttccttctttccttccttccttccatctctctctctctctgtgcttgcttgcttgcttccttccttccttccttccttccttccttccttccttccttccttccgtgtctctctctctctctctttccctcccttccttccttctcctttcttttggagtcaaaaattaatttaaaagatgtcatgtcatgttttaacttaggaagcagccttttctgctcacttggggtgttcatcttagaacacatgctatcatcgacgaacttctttgactgatcagaggaaatagattcaagttcttaccgtagacacaactgggcacagacatcaaaagagctctgaaatcagggcgtgcagagagccccaacacccacacaccagaacccagaggtatccctgcctgtgatttttaatttgacagtaggtggcagagtcctgggagacgtgggaagaggccataagagaatgcagacatgggaatggattaatccagagtccagccatggtctgcaggtggatctccctgtctcggcctgctcacttacaaatgggtgctcatttacaaatcggtgtgaatcacatttcatcatttgtgagctccttagtttccaagaagtacagttttctcatgtgtttcttggactttatgcatatgcctccagagtttgaatcatgcaaagatgctgccacttaaaaacctctttcctacaaacttacacccctccgatcgtggttttcctgtgaatctcagctgggcacgatggctgacgcctgtcatcccagcactttgggagactgaggcaggtggatcacgaggtcaggagttcaagaccagcctggccaagatggtgaaatcctgtctctactaaaaatacaaaaaatagccgggcacgttggcaggcacctgtaatcccagctacttgggaggctgaggcaggagaatcgcttgaactcagggggcagaggttgcagtgagtcgagatcacgccactgcactccaggctgggagacagagtgagactccatctccaaaaaaaaaaaaaaaaaaaaaatactgttagaagaatggaaaaaactatatagatggagagaaaatattagtaatctgatatctgataaagaactcatatgctgaataaataccaaacatttaacattcaacctttgaaaacaaagaatccaactaaacatgtaaatgatttgaagacattcaccaatgaagacacgcagaaatacacatacattcaccaatgaagatacacacatgaaaagatgatcaccataattattcattaataatgcaaatgtcaacagcactaagattcctctacccacctattacaatggatagaattcaaatacctgagaatatcaaattctggagaggatgtgggattctcattcatagctggtagacaagaaaaatgtttcattcactctagaaggccttttggccctttcttatgtagtaaaacatagacttacctttagatccatcagtcgtactactaggttttacctaagtgaattggaaactggttctcacatggaaaatcgtgtacacgaatgtattagtagtttattcataatcaccaaccaagatgtccttgaagaggtgaatggataaaaccaatggtacttccacaaactgaaagtgtattcaaagttcaatctaccctcaaatattccaggacaggaaattttggaggccagttcagccaagtggcaagggaaaatgaatcaccatcttatctcaactcttccaatgcatccaaaatgggcaattgtttaactcattctcccaggctcgctctcctagattcgtaaacagatgaaggcacccgagcactcatgaaaagaatttgtgaggcaagtgttcacacacatcgcagcaaatgtcataaacagataatcacatatccaacacaacagtggattaaacgaacaagctgcctgtatgcatggaataaaaataggattaaatgttagaaaaaaattcaattctaactccctgcatacaagatagactagaaaaaaacattcagtcatgacaatgggtacaggaaaaggctctgaaatgaattctatgtaagtacaaattaacaatgtttagcaaactaacattaaaaggaacttccatttcctaaaattggcagcaagcatacataaatgtgaaatgtcagaagctctgccattcacggcagtgacaagtcgttgacatatgctgtcaccactgccacctacatctgcagtgaatatcaaaatgaaaaagagccagagctatggatgtcaagatgaaaatgagatatgaagactgcaaagaaatagagtatttgttaactatatgattatctacatagaaaattcaaaggaatagacacattgaatattcaaatgaataaaagacttcagaaaacatcatacagaaggtcattaaagcaaaatcaagagccttgccacacaaaagcaacttagtatataaaatagaaaatagaaaatgcaccattcacagcagcattaaaatccaaaatgtaaataagaagagcctgacaagacctttatggaagcaactgtgcaaagttgctgatagactcaggaaataatctcaagtaaatggatctgtataccatattccttgatggggaacagaatatggcaaagatgtaaatgctacttaaattaaatacagagtgagtgccttaactgtcattgccaaagtgacaaccaagctcaggttgctgtgctctgctccccaaatcaaccccggaaaaaatataggagggaaaagattaaaaaaaaaacccatcaaaacagagaaagccctggggatgactgaagactgtgctaaactagtacttgtgttttgggtccagggagcagcagggaaatcgaggaggtctgtaccctgcatagatggcagattacaggatggataggagaaagtgtttaacattccaccccacatcatcgcgcaatctgaggcagcaccacaaaatctgatgccagtagccctggagtaatatcaggacaccaggaaatttgagttgattgagacactatggctccagagttctgctaacaaccacctgaaacaaacttagtaggagaagaccagccttccaaaaaattattattttaatggaatataaagaatgaactaggaatagaatagtaagtatgtgtgaaggccacatactatgagtagatattaataaaatatgtgtgcatatatatagtataaagtctagaaatacaaacgaatatgtagctaaagatatatacatgtaagtaaatataagatataaagatatatatgcgtgtatgtatacatataagcatagatgtatataatgtctaaaacaggtatgtatataaacgtagatataaacaaaatgtacaataccatatataatgtacacatacagtgtaaaatttattaccatgtgaatgagaattaaaatatgaaaatcgctaatctggactctgctgtgttcgataccttcaaaacacatggcttctccaaatctcttgctgctgctcagcctcttccgtgtaaaaataaatcttttaggacaaaaggtttgcaaagtctagctctggctggggaggagcccccatgggatggtgtgcatcttctctcacaggtcctacaatcacaggtgctgcagccccccagggagcatctagcctgggacccgcagccattctctgcaacgcgtgcagctgggcaaatgctcaaaggtgacataaacagatcatctcccacacatcacttcatcaaagagccaggagccaggaggagaaccctcctgagaggggactgaaggtccaacctccccacatagaggggccacagaatccagctcagcccttcctgtcagccctggaagaccctggcaatgttgtcaccctgaccacacccctcccctcactgccacctcatgtgactgggagtcagagacttggtccgagaggagcagacccaatgggcagagaatggggatcgagacccaggcatcaaggtcaggaccccctgagggatgactgagggcccctatccccatccccacccctactccgccagaacccggttcagcccctactggcaacccagggaagctccaggcttgggggccggatgtgacgtcactgacgtgcgcactgggggtcagagagaagggagaggcctccttctgaggggcggcttgataccggtggaggtaagctggccgaggctctgtgaggagtcaaggtgaggtgctgagggaagactgaggatgtccccaccccagatagaggacccgaaagaaccaagtgccgtctctgctcccagccctggaccacccgggggccgatctggggctgacttgtgaggctgggccgaccccctccctccgccgctcaagctgctgggcactctggagtgagagcttggtgtgaccagggcagggctggttaggagagggcagggcccaggctctgccgggcatcaaggccaggaccctgagggaggctgggcccccccaacccaaccatgacctacagccccaggttccccagccccatcctcagctccactctacaccccaccccaccccaccccaccccaccccaccccaaactccaccccacccccccaactctcccgcggcagaatctggttccgcccctgttgtcaacccagggaagccccaggtgcccggatgtacggccagtgactcccacactgggggtcagagagtagcgggggcctcgctgtgaggggcgggtcgatatcggtggagggaagcgggcccaggctctgtgaggaggcaaggtgagaccctgagggaggactcaagaccccccgccccagatagaggaccccaaataatacagcgccgcccctgtgccagccctggaccaccccgcggggtcgggcgtatcaggctgggcccaggctctgactggcatcaaggtcagaaccctgagggagggctgaacgcctccacacccctaacccagccaccaccaccatgacctacagcctcaggttccccacctccatcctcaccccccccccactccaccccacccccaagtctcccgtggcagaatccggttcggctcctgctgtcaacccagggaagctccgggtgcccggatgtaaggcctctgacttgcgcactgggggtcagagagtagcaagggcttggttctgagtggtggctgaagatcggcagagggaagcgggcccaggctctgtgaggaggcaagatgagacgctgagggaggactgaggacgcccccaccccagatagagggccccaaataatccagcagcacccctgctgccagccctgaaccaccccgggggcggacttctcaggctgtgggccacccttcgccaccccaccacttaagccccaggggactctgggtcagagcttggtgtgaccagggcaggactggttaagagagggcaggggccaggctctgccaggcatcagggccaggaccctgagggagggctgaggccccatagagggagtcactgcccctgcagtggaccctgggaagttccgggcatggcggtcaggcaagcggatcgtgatatctgcatcctgggctgaccgagggaaggggcttggtatcgttagcgtggccgcgggagaacagagggagggcccaggtcctgctgggagacaagggaggcctgaggggacccagtaccccaggacaaggggcccaccccgcccctatctgagaccgaggcccctcctcattcagcctcgggaatccgacagatagagactcaggtccacagaggggtggggcccagccctctaggagaccagggaaggaacaagacggaggacagaggggaccccggagtccagctcagtggggatcttggcctgggcgatcccgggcacggtggccgcatgtggtgcattgtggctggtgggatcgggtgtcaatgggaacagggctgtggtatgaggagtggggcctcaggtgagcagaaggaggagtcccagaggcctgaggaaggattcaccagacctctcatcccagacctaggaaacctgcccctgccgtcagtcttggaaggccccaggcaggacggtgaggaagggaagtgccccctccacccccaacacacactttctcaaagagggtctaagggagaaattggccttggtctgcaagactcacctctggttcagcaaaatggaaggggccagattctgtcagaagcaaatatgaatacctagaggacacccagaccgacgaggccccctggaacctgctcctttggtcagccttgggtatctcatgcatgagtgaccatgaggtggcccctcacttctgcctcccgggtctccgggaggtgggggccttggtccgaggggtttcctcagctcagcagagggagccacacctggtcagcacagggtggaatccagggtcttccaggagtgacggggaggaagtttggtgaggactgaaggtaagaaggtacctccacgctctcaaaaaagaaaggacctcacagacactggtgtcacctgttctcagccccaggtggccccaggcaggaatggcatgaggcatgctctcatttctcccacgtgactgggggtgagaggtctcagggaggtgagtaccttgatcccagggggcactgagagatccaacagagggctccacacctggtcagtagaaggaggactcccaggatcagcaggacccaaggtgtgcccccttcatgaggaatggaggtacccccaacgcagaaagaagccaccccacagagtctaggtgaactctgttcttagatctgggggcgggggggggcctgatcaaggatggtgctaagtggcaagctcatttgtaccacggcaggaagttgaggaaccctcagggggatgaggcgttggtgtaaagggagatgtctgctcatctcaagggtttgagggtcgaggaagtagaagccccagcaggagtaaagatgaataacccgcaggaggactttggaacacccacctcatacctgaagggttcagctggtggggtcagccccggacaccccacgcaggggtgacatatgtggggcctcctcacctctgtttctggatctcagggaggtgaggactttgttctcagagggtgtgtgtggacaaaacagggaggccctgtgttcgacagacacagtggtcccaggattggagagcagtccaggtgaggaacctaagggaggatcgagggtacctccaggccagagaaactctcagatcaagagagtttgccctgcccctactgtcaccccagagagcccgggcagggctgtctgctgaggtccctcctttatcctgggatcactggtgtcggggagggctggccttggtctgagggggctgcactcacgtcagcagagggagggtcccaggccctgccaggagtccaggtgcagactgaggggaccccactcaccaaacacagaggacctagccccaccctgccccttgtgtcagctgagggaagccgctgggtggatggactcccctcacttcctcttcaggtgtctcctggagatagggcctcaggtcaacagagggagggttccagaccctgcaggcatcaagatgaggaccaggcagtatcctcaccccaggacacatggaccccattgaatttagacatctcttactgtacttccgaggaaaccctgggcaggtgtgggcagatgttggttggggcatgtccttctgttctatatcagggatgtgagctcctgatctgagagactctcaggcaagtagaggagtagagtccagtccctgccaggagaaaggtcagggccctgagtgagcgcagaggggaccatccaccccaaaagtgtgtagaactcaagagtgtccagcccgccctcttgacagcactgagggaccggggctctgcctgcagtctgcagcctaagggcccctcgattcctcttccaggagctccaggaagcaggcaggccttggtctgagacagtgtcctcaggtcgcagagcagaggagacccaggcagtgtcagcagtgaaggtgaagtgttcaccctgaatgtgcaccaagggccccacctgccccagcacacatgggaccccatagcacctggccccattccccctactgtcactcatagagccttgatctctgcaggctagctgcacgctgagtagccctctcacttcctccctcaggttctcgggacaggctaaccaggaggacaggagccccaagaggccccagagcagcactgacgaagacctgtaagtcagcctttgttagaacctccaaggttcggttctcagctgaagtctctcacacactccctctctccccaggcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataatttttcctgttcactggctcattttttcttcagacacgcactgaacatctgttattcggaacaccctgggttagtagtagagatgctcggtaagccagacccacccctttgccatagggtggtgaagtctaggggctacaatcctaaaattaaggtggtgccatgtcctctaagaagtagaggaaaataaaacatgggtgagggtttggggctctagatgacagcagtcgagtgtatatgccctgagccagggccctttgggctttgggaaactgcagttccttctgggggaggtaattctattgaagctgggtggtgccagagccagattctcagaggatgagagaaaggcctggaatggacgactgctcagcagttccttttggatagtggatgaacagagaagagtctccacctggggcaggaatagaaggaaatcgtcccgcgctcttgtctcggtgcgcttgaacacagtgcaggggctaggtgatggatacctatcatctgcaagggtttcctgcaagatgagggtgaatctcccagaagggaagcccagaagtcattggccaggtgcttttctgcctgtctgggagagccagagttgatcgtatttaaaaggcattctaatcaagttatctcaggtgggatttgaccaattgtgagcaaaggctagatttcgagtgttaacaaaataagtgaaaacagagtctcggatccaaaagcaggtgggagagaggaaaggagttgatcctcgattcaaattctaggagctttgagctgcattcagctgcgcaagactccagcacacccaaattttgaagcacattcgctaagaggaaatacttaattttattgacgaaacttcctgttggggctgattatcccatgtcctactgagctgtatattctctggtaagtcttggagaacaacaacatttacgaaatcccagagtgctagggtctagggtcaaatagtattagatatgacagccatccgccattccttaaacttctaacttaatgccaggccctgagccagatgcttcacttacattgcacgcactctaaccgtcctagtggaagggcctcatcatacctgcttcacagatgaagaaccagaggctcacagaacttgggtatttcccaggatcaggtggctagtaaggaacagagctggaaccggatccctgatctgaattcctctagagcccgtgctgttcccactcccctgagccggaggcagacctcctcactggcacttcattcctcttctcagcaatgcatcatgtctctcaggcaacaaaaagaaggaccctgaggccaaggtactaaatgcaggcctaaagaaggtgccaatgagcatcaaatacaatttggggatggcatgccgggggtcccctgggaactgtctgctgggtgctgcctgttgagcacctactatgcaacaggttgtaggagcgcctacaaatgctcatccacatctttgatcttctctttcctgggcacaagggacgaatacataatcagcacttctgtctggcatcagcacgttcccgtgtcacagtgcccttccccggtcactatcatgtttcctcccttctgactctgcgacctgacctgctgcttgctcttcactgttgcctccccctggaggctgggcagacccccctgcccttcctgcaacatggagcattcctagcccttgaagtagtcccctggttctcgcacggctcgcccttagtccagtcccacagccgcaaccattctggacggtgactttagacacttggtcctccctccctgggagaattctactctgtgtattcccagtgggctgtgagaagagtccaatttgacccataagctcctggttgggttgcagcccccaggattgagagagtattttcgcagtcagttgcatatttgtagtaggattttattgagtttgttatctgaagctggggacagaacacgcaaacagacggatggtgctcagaaattcccctcctaagaggtagaagaggagcagccatttcatgaagctgaattcttacaaaccctgggctcctcccaggaggggaaaaatggttccatggcgaacatgccagctggagtttcaaaagaatatttaaccagcctttcactgcttcctgtctggcatctgtccccaggaacatgccggctttcagcgtgactagtggcacctatacaggtgttcaggtaagaacagtcatatggagggtagcagagatgatgggtaagattctgcccctgcatcagatggaaggaggaaatcctcagcttcctgagctgatagatggtgtggcaaagggaagtgcagaaaatgctatggagtgtacaaggtgaactctccatgctgaccttacaggatcctcttcaaatcagatgggttaatgcagtgatccccacccttcctggcaccagggaccggtttctggaagacaatttttccatgagcacggggtgggggtggggcattgtttcaagatgattcaagcacattacatttattgcgcactttatttctattattattgcatactcaccgtcgtgcagaatcagtgggagccctgagcttgttttcctgcaaatagatggtcccatctgggggtgatgggagacagtaacagatcatcaagcgttagattctcatcaggaacacaaaacctagacccctcacgtgtgcagttcacaatagggttcccgctcctatgagaatctaatgtcgccactgatgtgacaggaggtggagttcagcttcacctgcttgcccaaccactcacttcctgctgtgcagcccagttcctatccatggccgggggtgttggggacccctgggttaatacgtttgaaagcaccggtaacatagcagacacgttgagcatttcaaggcaaatctggtcttctcagaaacttctctaagaaacattgttgttgtcacaacagttaatagtttctgtaaagtgtcctctacttctagctgtgttcaacgctgttgcttctccaaaaccacgttttctggggtttggctttgttttgtgagacagagactcactctgttgcccaagctggagtgcagtggcaagatcacagctcactgcaatccctgcctcccaggctcaagccattttcgtacctcagtctcccgaatagctggtattagaggcatgcaccgcacgcctggctaatttttgtatttttagtagagacagggtttcaccatcttggccaggctggtcttgaactcctggcctcaacggatctgcctgcttctgcctcaagaagtactgggattacaggcttgaaccactgcacctggcccaaacccatgtgttttaaatttctcagattgacttcgggcctttcggcttgtctgatctacttaaagatctaacttttgattccatcagtattatttattgtttttctaaaacttctgaaatctcaatttcattaatttttctcttcttgtctatattatccccatcgttttgctcaccttaggtttaatttccttttccttttctagctatttgagatcaaaatatacatatttgagtcttttattactttctaatataaacatttcagtacataaaatgtcccctaggcacattttagctaaattgcagatattttaaaacatcacatttccatttttatttatttgaaaatattttctaaccttcctcaagaatttttttaaacatggattagtaaaaatgtgttgtttattttaaaaatacttaaggactttacagatatttcctttgttatattttgaattacattccattatagattttaaaaagatactttgtacaattccaattattttaaattttttatgggttgttttctggtctcttttggtaaaaattccacacacacttgaaaataccatataatctaccgtcgttctgaggagtgctcactaaaatctaatcagctcacatttgttctttgttgttcagctcctcctacacccttgcagaatttctgtctacttcaatcatttacttggagaggactgttgccatctccaaatatcattgtagatttggcgatttatccttgcagttctatcagatgtagtttcttgcattttgaagctctgcttttaggtgaattaatagttaagattattacgtcttctccccaaaagaaaccccctccatgtgcaattcatttatagctgtacccaccactgcgcgccgaaccctgacagccactcatctgtactccatcgtttcagttttctctttcaagaatgccaggtaaacagaataatagaatatgtaactggttgagactggctcctttcacacagcaaaacaccttcgagtttgaaacacattgttgtgtgtatcagtagttcattctttttcattgctgagaagtatttcatagtaagtaaggatgccccaaaatttcatttcccatttacccatggaaatacatttgtataatttccaggttttggcaaatatgactggagctgctataaacattcacgtacataggcttttgtgtgaacataaatttttctttttcccttagatgaaatcgctgagtcacatggcatgtgttcataagtaattaccaaatcattttctgcagttgtcccgtttcataactgccactagcaatgtatgaaatttcaagttgttcttcatccttgttagcacttacaagtatctcgttaaaaatttcagtcattttcaaatatgtgttatggcatctgatcatggtttaatttgcatttctctaatagctgtgatgtagaatagtttttcatgggcttatttgtcatgcgtatgtccttttgggtgaaatgtctattgatatgttttgcccttctaaaaaatgtggttgtttgtgttaaatgaactcatgggaggccattgttttgccctaatctctggccccagaccccagcagaacagacaaaatcagaatagtgtcccttgtactaattgccattcatcaaagtgaacattgaaacgggccagttctcaaaaaactaaaaacagaatagtcacagcaaccaataacgaggagcccaccgtacctgagcaggcacgataagaaagttttctctgctttaatcctacaaggaaatcaactttgaaatcaccaaaccaccttttgttccctgtttctacttttttcgtcctcttctgcctataagccaacgtcttttgctcagcacatagggacactcattcaagttgacggagagaaaaaatgcccattcaagaatcataaagaaaagccagttagatctttgaacaaaatttggtgaaactttgtgttttgacatgtgttctaagttttgagattttgggaatctttatacaattttcataaaaggcctttggtgtatatatgatttgcaaatacttgtgaatacttcgtttggctttttagtgtctcttcagtgtctttctcagagcaaaagttttaactctgaggaagtctaatttattgtttcttttctttatgaatcacactgctggtgtcatgtttaagacctctttgcctcacatcaggctactaatatttcaccctgtgttttctttaagttttttcttgctgttgttgtttgtttgtttgtttgtttgtttgttttttgagacggagtctcactctattgcccaggctggagtgcaatggcaggatctcggctcactgcaacctccgcctcccgggttcaagcgattctcctgcttcagcctcccgagtagctgggattgcaggtgcgcaccaccacgcccagctaatttttatatttttactagagatggggtttcaccatgttggccaggctggtcttgaactcctgacctcgtgatctgcccacctcggcctcccaaagtgctgggattacaggcgtgagccactgcacccggccttctttaaaagttttatagtatttcatgtaacatttggatctgtaatccactttgagttaatttttgtataacatgtgaggttttggtcaagtcttttttataacacatggatgttcagttgttccaataccactaattgaaaagactaatatttttccaataaattgtctttacccctttctaaaacctccattgctatattcgcgtggatctatttatggattctctgttttaatccattaatctatacgtgtatcccttagaaaattccataatgacttgattgttttaggcttatgctaaatcttaaaattgagtggtacgatttgtgcaattactctgtgttttgaaaattgttttaattatttcaaaacctttacctttccgtatgctttttgaatcagcttgtgtacaagtacaaaaaagcttgctggtattttactggagttacattggatctatggatcgctttgttacagatcacatatcttcactgagtcttccagtgaatgtacatgctatgtctatttagttgggccttctttgaatttttcatcagcattttgtagttttcaccatcctgatgtgtacatgttttgttagatatataccaaagcatttcatttttaattttattaaaatggctattttgtttttgtttttgttttttgggtttttttttggtaaaaaaaatcaagaatttatagtatagaatctacagtgtagctggagtcaacaaagcctttgaggataatatgctgtatcagctgggcctcaaatgattatttggaaaggaggaaagggcacacaagaagtgatactaaaagagcaaagtgattgagatgggattttttttccagggaatctcttttaattttaaattactattattacattttaagttctggggtatatgtgcagaacctgcaggtttgttacatagtacagaacgtgcaggtttgttacataggtatccacgtgccatgcggcactattcacaatagcaaagacttggtaccaacccaaatgtccaacaatgatagactggataaagaaaatgtggcacatatacaccatggaatactatgcagccataaaaaaggatgagttcacgtcctttgtagggacatggatgaagctggaaaccatcattctcagcaaactaacacaagaacagaaatccgaacaccgcatgttctcactcataagtgggagttaaaccatgagaacacatggacacagggaggggagcatcatacactggggcctgtcagggggtggggggctagaggagggatagcattaggagaaatacctaatgtagatgacaggttgatgggtgcagcaaaccaccatgccacatgtatacctatgtaaaactgctatgtttaaaaaagttttccaattttcttaaattcttatgttcactcgggtatgtaaggagctagatggctctctgcctctgacgcaaacaagataagaagctgaacaaattggaaaacaacaacttttctctgatccctcagagagctgaggccatagggctgattgctgacccaaaacggaagagacagtagatacagtcagccacaactttggagagcagaagctcaggagctgaatgcccagaaacaaggaccaggatacgaaaacctcatctttataagacgaatggtggagggctcactatggacaaatttgagaactaaaaactcctgggggcaccatccagaaggctaccacagtttccagagtttcacctctgggagccctatcaggttcccccagtgaggaccagagggagaaaggagtcattcgaaaatatgcccagagtattctgttcttcaaacgagggtctgccctcaagagaaactgttttaccagagtctgtcctacttggtttttttctagactctcatcaacactgggtaaggaaaacacccagctacaacattctggccccttaatgtctgtccaaggagaaaacaaaacaaaactgagaagcactagtgaaagccacagcccggtgtacactgactcaagcctgccatgtagtcataggaggatagaagtcttcccctccctctgcagctcactgccacatcaactggggaatgaaactgaaagaactgtgagtgccagaccatagtgaacaggttcccaaagaaaaccaaacacagccaaggaggaaaagtgaaggacaccacagggaggtttagcctctgacacctacagctacagcaaacagtaaacacagccagatgaaggtaaacctcacactaaaggcctatttaactccattcttttcatctgacacattgtggcaagtttgcaaaaggaaatttcaaagcatactaatagacaaaaaaaaaaaaaaacacagtgtgaagacaaagagcaggtatcagaaacagactcagatatgatagagatgttggaatgatctgactgggaatttaagacaagtatgagtaacacgctgtgggccctaatggaaaaagtggataatatccaagaataggtaagtactgtaagtcaaaatatggaaactcttcaagaacaactgaaaaggggcctgtaatcccagggctttgggaagccaaggtggatggatcacttgacatcaggagtttgagaccagcctggtcaacgtggtgaaaccccgtctctacttaaaaaataaataaataaatgagtacaatacaaaaattagccaggtgtggtggcaggcgcctgtaatcccagcttctcgggaggctgaggcacaaggatcgcttgagcctgggaggcagatgttgcagtgaaccaagatcgtgccactgcactccagcctgggcaacagagcgagactccttctcaaaaaaaaaaaaatgaatgaatgaaaaggaaatgctaaaaattaaaaaaagaatgaatgaataaatgaaaaggaaatgctaaaaattaaaaaaatatatagaccataagggaaatgaagaatgcctttgttggtctcatcaggggactggacagggtgaaaggtacaatcagagagcctaaggaaatgcaacagcaacttcccatttttattgccattatatgaagtacgataatacgattatcgtgtgttgagcttctaccttgcgacctgcctgcactcacttatttgaggagtttttgtgcagtttccttggtattttctgcataggcagttgtgtcttctgaggttggaaacaacattatatattctgtcccattcaagatgtctcttatttatatttcttgattgatttcactggtaagaatcccactacctttctgaataggagtggtgagaggggacatccttttcttgtttctctttttaggggtaggcattcagtctttcactacccagtttgatatttgctcttggttttctgtacatgtactctgtcaggttaagttcctttctatttctagtttcctgagacttttcactgtgattatgttgtacattctcaagtgcttttgtctgctttagttgaggtcatcatacatttctggatatagtggacagcattgatcaactatcaaatattaaaccagccttgcattctccagataaatccgacttttaagatattgctggattctatttgctaattttttggagattttgcatctatgtttgtgaagcatattgacctctagaatttttattggtttgtgtttccttgtttgtttgtactgttagcctggtaataccatggtaatgttaaccaggtaaaatgatttgggaaacatccccttctcttctattttctctgagagactgtgcaaattcatgttacttctttaaatggttgtacgaaatctccagtgaacctatctgggtctacagatttctttctcagaaagagttttactatgaaatcagttattttggtagctaaagtactcttcaagttatccattttgtctaaggtgagttccactagtttctgattttggtagaatttcatttcattttatcatgaattccatttcagttattgaattattctgcacagatttcttcttagcatttcatggctatcttcaggtctacaggttctctaatgatatttcctgtttcacttttgatcttaataatttgtatcttctctcttactttccatgactgactagagttccatccattttcttgatcctttcaaagaacagcttttggtttccatgatttttctttctttccttttttttttttttcggatttcattgtgaactatttctgttgtgtttttttctttttttctgcttgctttgaattaattggtttccctctttttctggttagttaaggtagaagctcacattatttatgtgagatctttcttttatcttaatctaagtaatgttataattttctctctaaacactgttttagctgcatcccacaagttgtgatatgttgcttttccaattaaattcagttctatggactttttaatttccttgaggctacctttttgatccttgaattgttgaagatggtgtcgtttaattccacaaggtatgataatttcctattgtacttatgttattgtttcatttctaatatggtgccatagaggtcgaagaacataagcttgatgatgtggatttttaaaaatctgttgtttgaaaaatgaaagaaagaaagaaagaaagaaagagagactggcaaggtggctcacacctgtaatcccagcactttgggagaccaaggcagagagatcacttgaggtcaagagttccagagcagcctgaccaacatggtgaaaccctgtctctactaaaaataaaacaattagccggccaggcgtggtggctcacacctgtaatcccagcattttgggaggccgagacgggcagatcacgaggtcaggagatcaagaccatcctggccaacatggtgaaaccccatctctactaaaaatacaaaaaaaaaaaaaaattagctgggcgtggtgatgtgcgcctgtagtcccagctacttgggaggctgaggcaggagaatcacttgaacctgggaggcggaggttgcagtgagccgagatcacgccagtgcactccagcctggtgacagagcgagattctgtctaaaaaaaaaaaaattagccaagcatggtggtgtgtgtctgtaatcccagctactcgggtggctgaggcaggagaatcccttgaacatgggaggcagaggctgtagtaagctgagatctcactactgtactccagcctgggcaatggagcaagactctgtcttaggaaaaaaaaatatatttattttatgacccaagagataatctagcttggtgtgttttccatgtgtgcttgaaaaaaggcatattcttatgttggtggtgctgtgatatttgcatccatagcatttctgagtcctcctgaataatggctgactactgggtgatggtctaccactagttcagtcctccagtcctcggtaactatgaagatttctgcgtgagcaccttaggttgagcccaggaatttctgctcaatttaatgtgttctcttgcttacattcgctactctcagtggtttttcccaagctcactgggtccctggggactttctctgatcctctagctagaaggtaagtcttttgtgtcctcacattgctgtgcatttccctttcaggggtcacgctaggcggccaagtgttgagaggatagacagagaaaggatttctctcacacttgtttttcctccagcttctttcaagattttttttctctttgattttctgcagtttgaatatgtacatagatgtatacttcttagtatttatcctgtttcctgttctatgagcttcctgaatctgcagtttcatgtctgtcattaattcggggaattctcagccattaccacttcaaatatttcctttgtttctttctcaccttctgaacatggtgtttcagttatgcacagtggtggtgccttttgtaactgtctcatgcttcttgaattttctgttacttttcttccttttttctctctttgcatttcaggtttggatttttgattgacgtttcttcaggcttgctgcttgttacctcagccatgtcctgcctattgatgaattaatcaaagatatccttcatttctgttacagtgggggttgttttatttttcctaataaattatttctatcatgataaaacacctatcacataaaccctcctaaccatggtaagtgcacatttcagggctcttaaatacatccatactcttattcaaccatcaccatggctcatctgaagaactcttttcctctgacaaaaatgaaacactatacccgttcaacaataactccccatttttcctccctctcatctggtaactagctttctatttcctgtctctatgaatttgacaactctatgtaccgtgtgtaaatgatatcctacagtatttgtcttttcatgcctgacttacttcacttagcataatgtcctcaggttcagtcacgctgtaccttatgccagaatttccttccttttgaatgctgaataatttcccattgtatgtatattgcattttcctaatccaattatgtgtcaagggacacttaggctggtttcacagtttagctatggtgaacattgctgctatatatatgggtctacaaatatctctttgagactctgcttttaattattctgggtatacattcggaaggggaattgctagataatatggtaaccctatttggaattttgtgaggaatcacatactgttacccacggcaattttgtaacattttatattccaacctacacagagattccactaacaccacatcgttgccaacttgttatttcctggttggtcgttgctttatttgttttaacagtagccatcctagtgagtgggaggaggtgcctcatcgtgcctttgattcctatttccctaatgattagtgatgttgagtatcttttctcatgcgcatcagtcacttgtgtatatttttaggagaaatgtctattcaaatattttccccatttttgattttgctgtcgttgttgtttttgtcatgtttcaggagttctttatatatcctggatatatatcccttaacagatatgtgatttacaaatattttctcccagtcttttggttgcattttgactctgttcattgtgtttttgatgcacaaaagttcttaattttcatgaagtctaatttgcctgtgttcttttattgcctagagtgttttagatttttagtgttttcttgtgattcttcttaaagagtttccatctccctgctattattacccacctgttcttgcatgttgttcactttttccattagagcccttagcttattcatcatagttgtattaattctcaagctggtaattctaacatctctgctaaacctgcatatgtacctgatatttactcttcaacctgtgatttttttttcccccttcactatgccttgtaacatttttggtgaaagccagtagtaatgtcctgagtaaatggaatggaagagaatgggcctttcagctgagagtttatttttatctgactatgcggtagactgtgtttactgtttgctggagctataggtgtcagaggttaaactttactcaggtgtccttgttttgttcttccctcctgtcttggatttccctagagactttttcttcttctatttggtttgtttcttttagacacagtgtcgctctatgttgcctcagctggtctcaaactcctggcctcaagtcaccctcccgccttgtcaaccgaaaatgctgtgattacaggtgggagccattgtgcctggcatgggactcttcttaaatgaagtttgcgatgtgcacttgtttcagtgctgctcccctgctattacacaggagcctactgacatcgtggtaaggcgtgggggagggaaagtgttctgcacacctatgagcagggctcagtctttttattggcctctgccactgtgctatgacctgcacgagtgcttttcatttcttacccccaaactctccccctactttttggttgaaatttcttgtcagagagcaggaatcacctattcgagggttttaggtgcctgcctgcccagctgtggttgatgctgcaaccgcaggttatagatgcaggactggggctggtgtggaggcaggtccagcaggatcgaaagatttttttccctcattacccatgtcctctatgggcctgccttcttagcttttggaccataaagagagaccttcatacatacagcttttcctatccttgtgcaattctcaaatgtaggctgcctttgagtccatgcttggagatacaagagggagaaatagcacaggaatttctccaccatattgaccttacttcaacttctggtttctttgcccagtgctccttttctgaaccacgcacccttttagacaaggcgtctttacaggaaattatcagtaggacctgacacagcagggcgaaaccgagctgcatatagatgtcacatacgccgttaggggtcctggactgaaccagttaacacgaaccccattaaccacagaggtgcatcttagacagccacgtggcttccctcttaaatttcagtattaactttttctttatacttggccaattgaatcaattggggcatcaattcaggcaggacacagctctggaccgttgtgacctgacctgaaagccatcctggactgaggccatgtcacaaaggcagggcacacatgggacttacaaccccgagggcacatgtggtccccctgcaaagacacacggtaccataatttgggcaccccaaggtggccgaactgagtcaggaagcacagaatatcaaggcctcactgtgatatatcaccatggcacctcctgccagctacaagggtatccagtacaggacacataatccagttcagtccctggtttcacttgcagacaatttggcttctccatgactggtagggagggcatctgaaggtactccgtggggaaaacagtggagccggggtctctccctctgtcccctagtcagcgaggtcagatgttgtcatgggtgcagccatcagtttggggtcacggaaattgcagctgcttgcaaaggcagtatggggagttttctttcagcaagagaagaaagcttccaggaacagttctgcaacaccaggatcacaatgccctcctcacacctccccagatgttgtgtttttcctccgtccttactaaatcagcatggcccactcaataataaaagctttacattgtttcaatcatccccttatgcctgaggccttctcacctggcagggctgtgtgtcatggggacaaaaccattttcacagtaaaacactgtcataaaacaagatgtgaacagaaagacccatcatgtttaggaagcagccaggaaaaaatcctatgtttccaaaagattccaaaatgagtttgcataccccttttcatcctgctcatttatgcagtaaacagtatagaacaataatgataaaaagaaaacaaaatccatcccttcctgggctcagctgcatttgataatcctactgcctggcgtgtggaccaggaggaaggagaggaagcagagttaggctgtctgtccactatcaaaaactgcaactgaagtgggtcctgggacacaaatgactggcagtggacacgctagagagaagatctgagactgatctgtcacgcgtgggtggagaaatcacagtcgatggggggtgccatcccacaacatgcagctttcagcagacatcgcacaagttagaagtgcaacctgtctgcatcagaaatacagtgcccatgagcagcttcactccagttggccccaccggagaacaagcccttcatcatgggcatctgcaagagatgtgggaggtctgtgctgcatctgtgctgtgtggtgacggtttcgaaccccactaacaggtgtttaaaacctgccagggttccagagtcaaagatgcctttgttgcattgagctatgcctgctttctgcttggcacagcttgtggtgagtccgaaacagctcagagcagatactttggttttagtttagagtcaaggccagcctattgagatttgtgactttgcaattccaaaacagtcgggggtgggaggaaggggttctgtagcagcaggatagccagcacgctgcaaggccggaaaacagtgaggcagggagacgcctgcctggcatgctttcctatggcctttaggccttgccagtcttacagtccaaacatgcacctcaaatcacgcaccttagctccgacagtcatcagcttatacgtggctgacatcccagttcagaagagctcatttcacactgtttgggactgggggttgatcaaggaaaatgagaggatcaccagaggctgtaccatacaagcagctttattgggtggtgcttggacagggaatgcagggaggggacagactgtccagagtctatgtttccagggtcaccatcagaacggaaggaaggcaggagaactgatggtgcagatgggaattggagaaggaccttatgagtataggtgatgttgctcagcagctgggccaagtggcttgggagtctcgtaaccataaggttctatcttatctacggttagcagatgttaggtgaggactagcagggtatgcaagcgaggaaggctctgaatgcctaaaaacgtacttagctgtgccacgtttcaaaccatcaactgtgtgaaacattcagttttgtgctgatgggcttctgagccaacaggtctcagtcttgtgaagaaaaacagtagagaaacatcagcagtgctgcacgacagctgagatgctactgcaaggccctttgccagccacatcccacgtctaaacaataagcaaggccttcctccagcctaggggctacacacacaggtcatctttggttcatttatagaacacaagctgaaaactgtttttaaaatctctgaagatgtatctccacctggagaccgtctctctttttccatgtggacttcctttctccagggatcccaggaggcaagaattatcaccttcagaaacactttctgtttcccatacttgaaaagcttaacgcgaacacacacgcagagttagagagaaag

SEQ ID NO: 628 - DNA, 30992 bp, Homo sapiens
agagtgacagaagatacatatgagtgtgtaaggtagattgtaatcagtagagaccagaggtagacattttatacaattcataaaaacactgacaaaaaatggatcattttcaatactgatttgttaagcagtttagtagagttactaaaatacaattgaaacataaaaatacctgggcagctgccaaaacaaaactcaagagaaaatgtgttcatttaaaatgtttaagtaaaagtagaaaacaaagaaaaaaaaaaagaggcaaaagaaaactagtaaactgagtttctaagaaatttggggaaaaagccaaaacatgaaaataataaaactaaaagtagaaatatagatataaaaatgaaactgatcagtaatcccaacagctagctttttaaaaaaattaaactacaaagttgatcaagtaaaacaaagtaatacaatcagtaagttcaaaagatgtaattcatacacactcctagttggggaaagaaagaatagtatcttaactatatcaatatatttgcaagcaaagtctaaaaggtgactgcatagccaaaaggaaatatcaagcctgatttgcaaaagaatacacaataatatgcaataatacagtgataagaaaatgtatttacaaaaataacttatggtcatagcctaaactactttgagttacttttcaagaaacattcagaccagattccaagtataaaaatagactgcttaattctccacaaacctgggagaaatgggaggttctggtttaacattaatcactacttcttaaaattcacttttccagttacacctttagaatggatttattccactctcatttgaatctgtagtgttagtatacgatgaatcactaagtagtgctacctgggccaaagctagtatcctctctgaaatttacatggagctttctgctcaggctcaaattccctctctccactttgcagggttgggagaatagggagggagaaaaggaagaagggagggagagagagaatatacttagcaaaggaatgatgactctgaatgtaaaagttctagtatctgttttctgcatatcataagaatgcagctggactctttttagacctatcagtttttttccagtggaagctgctggcttcactggagcacatacacgcgcattaacacatgcctgcatgcacgtacacacgcacaagcacatacacacacacaaactttggatggcacatcccagtctaaagcttgacagaatggctccaaatgacaacctgacatactcacaaactatcaagggaactgcccctcttacaccttattaaccaaatttaaagtcttttagtggagactttagctggttttattaagataaaaaatgtttaagagcatttaaccagtagatacaaaaaagcacaaaagccaaataaaagcagagcccaggccagtaggaagatctgcatttaagttcctcaactgccattcatcagcggtgtggtcttgggtgagttattttcccccaggtctgtctcctcatctgattcctcatatactgattcattaagacaagggtatgtgaaagcactgtgtaaatgatacattttacccattctagctttagcagtattatgaaagacaaaagttctgccacattgtaggtaataatctcatttagcaatcattgttgtcactattaggttggagctgacaaagtatgagtctccacttataaagcatctatctccagagttcgaggcttttgtcttaaattccagtcatcttgtacaggcatgacatatcaggcaaaatgattagaaaactcaagctccatattaaaaagcttaacttctggagtcctaggaaactatctaaaactccttcaatccacggtctctcctgtacaacaaagacttcccagtggtagatgtctatttgtacccaacatccactcattcagcacgtaattcagcacctccaaatcctggccctcaaagaacacagctaagaacaatgtgtgtgtaattatcaagtaataggaatgatacttttaaaactggaaattatacattcaaatgagatttctctcctttaaccagtccccttgggaggcaatgcagtaattccaatggtacttcattactcaaatcatctttgaagctttcttcttggaagcaccttgagaacctgcagtctgatcttctgactatcccaaatggtgctaaattttcactgagggtggattcaaattttggaaatggcaaacagtcagtcagagccaaggttagtgaataagatgtgtgatcaaactaggtggaactattttggttgaaaatgatagatgatcataaagcaatgagatggatcttcttatgtgatatgtaaactgactttaaagggaattccagatgagtaacaaggagtatgaacaatggaataggtgtatacattctctttccccaagtaacctctttgaataacaacactcatttggatgtataagcgccactaacaggtttgttttgtttaatcacttacaatttgtaaatagagggttccttagcatactggatctacaatgtcatggaggaaaggagttgtcacttaactagaactatggcatggcacgcaggaaagagcacaggcttcatgagactgacgtggattcgaatgttgacttagattcttcctgcctatgcaacttcagggaagtcacaagctgtcaagactttaaaataaggctgatacctaattttgcagggttgttgtaaagatcatggataatggatgcaaagcccctacattgggcctggcatgtggtgggtactcaagaagtcacagctattattaacagcaacatcagtaaaatcaagaccattttctgactgtaggtggcttgagaggacagaacaacagataagcagtcacttgagtggtaagtagttcattgacagtactgacagtacactcgtgcattagatactgctttcttaaaaacaataacctgtaaaaactatttgcagtaactatgtatttttaattcatacgacacatatcatctgcagtgctcataccacatggacctcttcactacctgaacataccaggcactatcatgaccccatgcctttgtgtactttgtcccttctgagatactgaaaggggccagcccctccacacctgtgggtatttctcgtcaggtgggacgagactgagaaaagaaataagacacagaaacaaagtatagagaaagaacagtgggcccaggggaccggcactcagcatacggaggacccgcaccagcgctagcctctgagttacctcagtatttactgatcattatttttactatcttagcgaggggagtgtagcagggcaacaggtggggagaaggtcagcagggaaacgtgagcaaaggaatctgtatcatgaataagttcaaggaaaggtactgtgcctggatgtgcacgcaggctagatttatgtttctctttacccaaacaactcagtgtagcaaagagtaacagagcagtattgctgccagcatacttcgcctccagccacagggtggttttctcctatctcagaatagaacgaatgggaatggtcagctttacacagagacattccattcccagggatgagcaggagacagaagccttcctcttatctcaactgcaaagaggccccgctctttcactactcctcctcagcacagacactttacgggtgtcgggctggggggtggtaaggtctttcctttcccacaaggccatatctcaggctgtctcagtggggggaaaccttggacaatacccaggctttcttgggcagatgtccctgcggccttccgcagtgcactgtgtccctggttaatcgagaatggagaatggcgatgacttttaccaagcatactgcctgcaaacatattgttaacaaggtacatcctgcacagccctaaatccattaaaccttgattcattacagcacaggtttctgtgagcacagggttgggactaaagttacaggttaacagcatctcaaagcagaaacaatttttcttagtacagatcaaaatggagtttcttatgtcttccttttctacatagacacagtaacaatctgatctctctctctcttcctcacaaggtacccttcctactctctggtctgatgacaaccctacaattctagctcaaaagtctggctcaaaagactagctcaattcaaaatctagctcaaaagtcatttccactatagactcttccctgcctgctcgagacagaattagtagctctgccatttgtacttctaagacatttggtttctttcactgtaatgcctcatactctattgaattcttatttccctttcatttctgcttcttccactaggcttacgcattgagaggaggactatattcctttatttttgtacttagagcacctagtacatcacttggcacgagataggaatctagatgtttgaggaatcaatgttataatatactttgcaaataactgttagaggccaggtagctgactttagtgaactatattaccagcaatcgcattcctttttcctgcttcaaacaagagacaagataacttatatggactccagaatgtcttctgaagatggagcatacagaagtctccaaacactactgatctcatcagtaccccatgcccacaagttggaacccccagagcaacacttctcagcctttgttccagtctagcacacctgagggatacaccacactcccatcaggagctcacaacagatgactaagaaggcccagcagagttttcacagccttccagtgccacatggctaccagggtggaagggccttctctgaaccagcaactcccccaaagtagcagaaaatttcaaggctccatggtgagtgccgggagcccacctaatgctacctactaccagatccctaccacctacaatgcctcagaatcagtttgcctactctaagaacagggctctttcactgttaggaagcctcaggcattcaaggaaggacttgtttgtgggtccggtacatctgtttcggcatgtcttaacctgcataactaaaaagcaattatgaaaagaagttcatgatcaaccagttcagtgccagatggaaataggtagagtgggtcagctggcagccctgtacatctgagtgttgacacttgtgaatcattctctgtcactatagtttccagagccttgccaacgcagcagtgggttcagacttaccaagatccaaaaggctggaaaggggatctggagccatgacccatgccttgggacccaccaaaccatgacagtgactatttctatgacaaagacatgctcttcaaagtaaatatagccatattctgccttagtgccatgttctctcccatctctccaaagcaatggctgcactctgaaggtgggaagagtgtgagaagaaagagaaccaggccacagaccaccaggaaagcagtgattgaaagcagcagctctagatttatcttataggctctggagagttattcagttatttactccacaaatatttattgagccaggtactattccaagtatgcaggctacgatactgacacagtcacggccttgaccccatggagcttaaagtttagtgggggaggcaggtattaatcaaataagcatccagacagacacaagggtacaaatatgcactatgatggaggagtagtaaatactacaggaactgtagaaacagggagcagtaaatctggtcagggaagtcaggaatgcttcccttagcaagtgccaagtgaggataaataggagttcactaggtctggaggagaggaaaagagagggaaacattcctggtaaagagaacagtgtgtgacaaggtcctggggtaggagggagatgttgaattggttcaaaaatagaggcagggagcaaagcagtagcatcaaggtttgagtccccagcataaggtaacttcctgtgtacacccctcagttttctttctcctatagagaaggccttcctcagcatggaaggagactaaagcacactgtcaaaaactaggagtgctcaggagaggtgaaacactaccagctaaaaaaacaaatctgatttaccaataatacctggccaatgtcctcttgaaatatctgtaaaattaaggaactcactacctctggcaacaatgaatcaggaaaatggcacagtataaaagacctttaaacttttcaggtagaaatacattttaatgcaggtagaattaagagattgatgaatatgttgagaattactataaatctgcttagataccaggtatttcactgtaatttcatatactaatttttttggggggaaaagggctaaaggaaaaaacggttaaaggtagtatcagtgcagcactattttgctttggcaactccgttagcctgtttgatcacttaaggcagtttcttgaggcttctgaattctctgtcaccttgcaaacaagtcactgtagctttctatttgtaaggcactttgtaatcaatccttaattggcctccctaccccactgagagattatactcattctacagataaaacaatagataagtgagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagggcacatacaaagtcacaatgactcacaagttaaaatgtcaccatccctagggagactgcaccctcaacatacaaatactcccctaaaacttcctttcatcctcaacaagcagccaaggcataggtccccagagttggcccccgcagtacagcactgcacagtactgtaaggcatcttaagtgtacaagcccttcttcaccccatgctgagaccgccagcatctaaagcacctaacataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcctcatttttctaacccagttcagagcctccttggatcctgtctaaactttgtggtcacttcacacctgacctctgcctccactccaggctgccctacttacaagtaccaggttcatcttccttgggcaagtcaacatctttgagtctcagtttttctcctccgcagaatggaaatgataaaaacctcttttctaagcgtgttaggaagattcagtgagatcgtgtgcataacacactgcctggtacatgctaggtgtacaaagaatgctgttgctatctggtactctttcaggtgtcaacctcctcaaggattttgtttgcttttggaatccaagagcaggacaagctcatagcaggtgacctagtttaccatcttcactttgggcagatttaagttttcatgagcacaacaatgccttaaacattagtctactatcattatggataatagtcatcctttgttgcaatagcagagtttcacaaatgacaattttatactgtttagccccaagggcagcttgagagaatcacaattgcgatagtcatacttagtcttgatgtatcacctttcttctgagaacgtaaaaacatatcataagtggtaattaagcttcccaacacccactgggaaatggatattattatatgagctgattttaaggttgagtaatccaaatcaagttttcatctgctgaagcaccaggaccctgtcccagactttttcacccatcttcctttcccatcctctgggtaaagtccaatgtgtagcccagaggaggttctcaatgaacactcaaatacagacgaggaattaaggcgcagagaagcttgtataacaggccctgagcgagccagcaagtaagggtgaaggagcacagatgaaactcagggtctagctgaacctgcagcccatactgttagaaagaggtgcttgccagtggtcagattggacagcaccatcttcattaccagtgaccgtgccccaagcaggcatgagaagatggtctgccagttcagacacttgaataacaggcatcactgccctttcaagagcttcatagatagagaccaggcaggctcctcagagtccagaatcttgagggcagacgctactttaatgagatcccagggagtctgggagctgaaccactgctctgcaggcccacaagttcaattttagcagttcttccagagttgaccaggccctggaagctatctagcaaaggcaacaggacactgatgcacaaattacttgtcagtgtgttcttttgctctgacaaggtaaattgccaagaggaacatatgaacctgtctgtgaggaaatacaggaagaactggactttcccaaggcttcacatccccagtcttcaagaggtggattacctggactgattctggaagcccaaccctttatgctactggtgctctcatggggaaaaaaaagccagaaaccagatggccatctggtcctctctccagcaagtgcaaaagaccctactgacaacctgctgctcacttcagagccctcactcagtgtcccaccctagatggaggtccaaagcctcaatgacctgtgtagacagacccacaagtgatcctgacattaaagaaagaccctgggtcatatgcaggcaccaggagtgctgggaagcttaattaccacttattaaatgtttctacattctcagaagaaaggtgatacatcaaggctaagtatgactagtggagaagatgacacccacatcttctccactagcagagtttgactttatcttttccttgacttgccaaaaaattccagggctatcttgctaggggctcccaacattcttcactcaaaggaaagaaatggctctggattgaaaaagtatgacccccaaataagccagacagcatattcttgtgactttggggtgggcttaggttacagtgttccagaagaatcagtgtatatctgaccatggttttaaggactaacttggatttgtaccacccttctgataagctggtggcttgtccaattcaatattcacattggcttcaatgtggtgatataggatgcctctcctctgaagagcaaggcactggtgaagagaatcctggtgaatttagacacttggactggggagacctggcataggggaagaaaatggccgtggaaccgccctccacacaccaccaaggctccttccctggctgcagcagtagaatggagagagtgtggaattagtagatttgaactcaacaccagtttcacccttgctccagtggagggagggccagctgggatccagtcccgtgcaaggcctatgggactataaagagcttctcggaggtcagattgacaagttctttagccaggaaacatggaggtgccagcctgcaaggctttcttagcctggaattcctcaccctaggttccctaaagtccacactttgaatgccaccaattagagaattgctgaagatgctgggaattagtccacctgcagaatgcaatctcctgcttcctgacagaaccctttgtttcaggcaactttagcctaacttggatacacatctgagatctccctgggaggtgggtgggtctggagtctagacagggatttgattaaatacggggctagatttaggggcttggagaactggaggaggagattgcagggaggcaactgaagggaccacagaggtagtagctgtagttctgcttggacttgcagcaacccctatggccttccagagcccagaaggagccacctcctcagggagtcttccctcaggtaggcaaattacagttactgagagagaagagggagggaggacagtcccaaggccccagtggacctcctgtcacccagggtagccctgggagtgggtggtttatcatccctcatggagcaagctttctgctaaaggaagcaggggccatttcctgttggaaggcagaatggggagcctttgcctgggccagcaaaccaccacggtatccctgtgcttctcctctggacctctcctgatgccagggtttccaggaagccttcccggctgtgccacactcctccagtgtgctgtgtatgcaaagcccaggtcaagtgtgtgtggccaagcacacggggcagacaaaaaggcccatgcttgccaaaggtcaccaaccagctgcccacatgattcctttttctccttgttcccaacctgctctcattcctgaatctccactcaatgcttgtctttctccctttctgtttccacactgtatttctgacacattcctctggggccctctgccctaactaatcaaatgtgctcttcctcatcttgccttcccctaatggatcctttcatcttgggtagcctgtaaccttcactcctttagttgcattcatctgacatatgtcttccagagtgtctgctttgtgccgggcactgtggaaggcactgggaacacacagatatgaataatgaaaacacagcattgtgcacgataagcattggggatgagggaaccgctgagctgaaaaaataacattgtaaggtaggaagagaggaaatgaggttccaggcagagtaaacaacagttgtaaaaacacagaagtcagtgaatggaggcaggtgcaccattttggagaacaatattgtctgcaaccatcctcccttcccttcccaccaccccactctgcctacaggcagctgtgcgtgtgctctcagctctctgtgcttggaggagtcagttttggagtcccatgatgcttcccactatgcccctgtattcttggatcctggcatgcagtaggtgctcaggcaatggtcatgaaatgaatgctgatgttggacagtcacagggcacaaacaaaaaagcagttcttcctcatcccttgcctcaaaccaggcaacttgtgtctgcaggaaaaatgaccctttctttccaagtttctaatagctgcagacattatgtgggtacccacactcccactttcctacaaatcattgacatgttgaggttttttgtgtcttattataaaacaacttataccatgcttgtacagttctaagatgtgagatgaaccatctatttaataacagattttcaagggtaaaaccctgcatgaatcaatgtacttatgcatcttaagatctgtactctttcagaaatattaccatgtacaggagaaggtgcatcttagatgttcagcagtaattgctcctttttattcatcataagaaggcctactttgggccatcttataatcgtcgttatgagttgaattgtaccctccaaaatatacccttcaatatgctgaagtcctaatccccaatacctgtgaaggtgacctcactggtaatagggactttgcagctgtaataaagttaaaatgaggtcattggagtgagcccttaatccaatatgactaatgtccttgtaagaaaagagaaaatgaaacacagacccagagagaagacagccatgtgaaactgaaggcagagactggagtgatgctgccacaagccaaggaacacctggggctaccagaagctggaataggcaaggaaagatcttcgcctagagccttcagagggagcacaaccctgccaacaccttgatattaggcactgaacctccagaactgagagagaattaattggtactgttttataccgcacactttgtggtataacacttcggtatggcagtcccaggaaactagcgcaatcttacaccaatgctccgaagttgtgctatgttttggtttggctgtgtccccacccaaatctcatcttgaattgtagttccccatatccccacctgtcatgggagggacctagtgagagttaattgaatcatgggggcaggtaccgtcatgctgttcttgggatattgagtaaattctcacaagatctgatggttttataagaggccttttccctttttgctcagcttttcttcttgctgctgccatgtgaagaaggacatgtttgcttccccttctgccatgattataagtttcctgaggcctccccagccctgcagaactgtgagtcaattaaacctcttttctttataaattacccagtctccggtatttcttcatatcagcatgagaatggactaatacaccccgtttttcagatgaggaaactggcagatcactaggggtcaagcatagaaaaggtgcagccagaagaactaatcttttatagtctgtatgagtcagggttctctagagggacagaactaataggatagatatatgtatatatatttaaagatgagtttaagtattaactcacacaatcacagggtcccacaataggctgtctgcaagctgaggagcaaggagaccccattgaagctccaaaactgaagcacttggagaccgatgttcaagggcaggaagcatccagcacaagagaaagatgtaggctgggaggctatgccagtctagtcttttcacgtttttctgcctggtttatattctagccatgctggtagctgattagatggttctcacccagattaagggtgggtctgcctttcctagcccactgactcaaatgttaatctcctttggcaacaccttcacagacacacccaggatcaatactttgcatccttcaattcaatcaagttgacactcagtattaaccatcacagagtcttacccaaaccactcggaggtggcttccagttcattatgggggcataagtgtgtcctcagagacataattcctcttctggctgctttctgggaggaaatgtagaaaaggaaattggaaatattattggcacaagagaggtttgcagttgacaagtaggtaaacccaggctgattcaaaccttgaaaatgattgtgtgagcaacgatagtttttttaaaaatatcaatagttttaggggtatagttggtttttgattacatggataaattctttagaggtgatttctgagattttggtgcatcacctgagcagggtatgttgtacccaatatgtagtctttcatccctcacccctgcccacccttccccctgagtgcccaaagtccattacatcattcttatgcctttgcatcctcttagcttagatctcacttataagtgagaacatacgatgtttggttttccattcatatgttacttcatttagaataacggcctcgagctccatccaagttgctgcaagggccattatttcattctgctttatggctgagtagtatttcatggtgtatatctaccacattttctttattcacttgttggttggcggacatttaggttggatccatatttttgcaactgtgtattgtgctgttataaacatgcgtgtgcatgtgtctttttcatataatgacttcttttcctctgggtagatacccagtagtgggtttgttggatcaaatggtagttatacttttagttctttaaggaatctccatactgttttctgtagttgtactagtttacattcccaccagcagtgtaaaagtgttccctttttaccacattcatgccaacatctatttttttttatttttaaattatggccattcttgcaggagtaaggtggtgtctcattgtggtttaaatttgcatttcctagacaattagtaagaatgttttttaaataatcatgtggagggccaacctgcaagtacaagctgtgacagaggtaatttggaatgtggctccagcattcctcaaaaccatgaacttgggaggccaggagaatgcagtgtggaaccttttctttggcattcagggtgtccagccagaggactctccctcacaaagctttggggtgttgggttgaatgcaaggagggtgggcctggaagatgtcttggaagccttcttcagggtcaacacccacagatccatatattgatcctggccccagttcagtgaccctgacttttgccccagccagggctagaacaagttataccatatctgcacagttccgagatgtgagatgaactacccacaacaacagattttcaggagaggaagaaatgtaccaatcaatgcccatgtagactctaagacaaatattggtacagaaacattaaaaacaataaatggaggcatttaaaacaaatatacatggataggaagattcagtattgtcaagatgtcagtttttcctaacttgatctatatatttaacaaaatcccaattaaaatccagcaatttattgtgttgatgtcaacaaagggaagggctggcaagagccaggcaggaggtcagctccttgccaagggggctggagttcagagtagggggttagccatggctggtggaacagggaggtttcccagggaagtgagaccatgtctgtgaggcctcccacccgcccctcagggggcaggctcaggacatctggaaaccctcaagacctatccacggatgggcacagggaggctcctatctgctccgccctgacatggtcaagattggctctgtcctgtgtgatgtgtgcccacactagaggctgctgtggaggatgctggaccctgtaaatgcctccaggggaggctgtgggggtgtgtggaacatcctagctgctccagccctgcagtccttaggaaacacagggtgagcactctccacacaccttggctctaagaagggacatgcagtatccctgtttccagcagtgtccttccttccattctggagtgccacacaggcatctgtgtctggccattcccaggagtacctggctcataacatggtccagcctcattctgctcccatgtccctctccccacagccagcccagggcagtacagctggatttggcaggtgctcctcctcactcatctcctggggtggctgttcctcagcatggaccccaaagccctctcacaccaagctcctttcgaaatcctaatgtgggtctaagtgtattctgggaactgaggagtgttgcgatgttcaccgcccccaccatctgctacagcctttagtcttctttaactgcctctctgggcatactgaggccctagctgcctctgctaggacaccccagccccacctctctggatcaacctcagaaagcaaaacctcattgtcgcccatttaaggtaatcagttaatcaaaagccaggcattacatgggggattatttgaatagtacctcctaatcatagtaatttgtcactcatcacactgcaatgattattatttaccaaccactaggagactcgccaaaaacttcatcatctcctgccagttctaccacaatatcttggaaggggattccttactggggaatttcaaatgatgatatttgcgtgttaacataatcatcagatcctgtcttgggcccagtggttgttagtagagataagaacggtaaagctgtaaacagggccaactgaggccaagtattggggactatgggcaaatttgggcacagcaacgagagaaggaaacccctggtctcaactgagattttggctattttggccactgccttccacccatactgaggaggacaacaccactttcggaagcctgaaggttgcaggtcacatgaaaaacttcctgtagtcagcatcctatggggtgattcctacccagggccttaaatgcacagaatctggtttctcacatctaaaggagcaaatgtgtatgacaactcctaggtgtagagtgatctgtgttctgtgttgttatggtttgagaattaatgtattgcttctgcagcaccttcaatagaaatgactgtgacaaaataatgtgtctgcttctatttcagtggcaaagagtaatcacatgacccttcctaacttcaaaaggactgtgatgttcccctgtgttcaggaaggaaaggaggacaagacatagatgagcacttgtagtatctcccataaactgttttgcagatgtccaacataaagcaactacaattaatccttgaacaacatgggagttaggggcactgaccctccatgcagtcaaaaatccacctataacttttgcctcccccaaaacttaactaataagctattgtcgactggaagccttattgatgatgtaaacagttgattaacagatatttttgtgtattatgtgtataatatgctgtattctaacaataaactataaaaaaaattaagaaaatcataaggaggagaaaatatatttactattcattaagtggaagtaaatcatcatgaagatatgcgtcattatcatcttcacattgagtaggctgaggaaaaggaagaggaggggttagtcttgctgtctcagggctggcagaggaggaagaggtaggaggggaagcaggagaggcaggcatactcagtgtaattgaatgaaaatacgttgtaattttctttttcttatatctaaaagtttctatatggtaccaatccttcttccactgtttgttttagtttcagtgcccacatcatagaagggtccatgtcgtaaaaggagtcaaaagcagtcttaaaaaattggaactcttctgccagattgtctagtgttagttttttttcctggcaccgtttcttatacatctttttcctcatgatctgtcactggtttggaaacactcatctccatcaagtcaccttctgttatttcctctggcatggtgtctattagctcttgaattttttcaagattcatatcttgaaatcttttacattccatcttttggaccatatccacaacctctttcattgtttccttatttgtctctgtcgtaaatcctgtgaagtcatgcacaacatctggacataattttctccagcagaaatttattgtttaaagtttgatggctttcacagattttctataacaataatggcaccttcaatggtaaaatccttccagactttcataattttctctctatggggtttctcttccatagcgttgacaatcctttccatagagtaccatgtgtagtgagccttagaagtccttatcctgatttagaggctgaattagagaccttgtgtttggggataacttcgatcatttcagcaccctcaatgttgaactcattgggttctgggtggccagggacattgtctaatagcaaaagaactttaaaaggcagtcacttactgccaaggtacctcctgtctccagggacaaagcatcgatagaaccaatccagaataagtgttctaattgtccaggctttcttgttgtacaacccaaagactagaagctgatattttatctttccctttcaaggtttgagggttagcagctttatagataaggacagtcctgatcacaaacttgactgcatttgcataaaacaatagagttagcctattgctttgtgccttaaatcctggtgcttccttctcttcctcactaattaatgtcctttgtggcatttttcccccggagtagggtattttcatctgcattaaaaacctgtacaggcagatatgttttcttctcaataattttcttaatgacgtctgggaacttgtctgctacctcttggttagtagaagctgcttttcctgttatcttgacatttttcaagccaaatctctttctaagattatcaaaccactgcctctatcccagtgggtatatatatatggatatatatatatatatatatatatatatatatatacctgtgctttgcccaaacttgcccatactccccaatatctggcctcagttggcccagtttatatataatgtgtatacatatatatatttcattttattatgtatatatttaaatatatatgtatatacataataaaattattgaaccatcctttgctggcattatattctccagctttatattctacacggatcttttgcgttaagttatcatataataacttggatttttctggattcatattagaatctataggtatgcctttcttgtggcaattctgcaccacataaaggctgcatttgccatatgggataaaaaggtgtttcacaaaatgtgcaaggttttcacacctgctgatgtagttgcagaaacagcttcatgaatttctttttctttttcttttttcttttgtttttacaatggttcttatgcagatttcattaatcttgaaacagtgggcaactacagctgcaaatccaatctacggtacatgttaagcaattcaacttttcttataatgttatttcttttctctgcttcttggcaggaattccagcatcactagtggcacattgtatagatccaatggtgttattcaagttttaaagtattggactaaacatgatggaaaatacgtgagaaccatgagagatcactttttactgctatacgcaatttactggagagacaaactcctcacatggagataattagcgtcccatggcttttcaagcagatagaagaacacttgagcttactgcaatagcaacaggaggtggctatgaaattattacagtagcacagcttatgctacagttaattttatgcagttatgatttaatactacatctcaacatttgtttacatttatcttgactgtgaataataccatgtacggtctgtaactttttgtgtacataaattttgataaaaccttttacaatagacttcatatattttatagtactaaataacaaaatatcctagtatccacatatattttattcattcatgacataactctttttttatatctctaggctatgcagtttgtgagttttttcaaattgttgcaaactccaaaaaaatttccaatatatttatttaaaaagtctgtgtataagtgaacccacatagttcaaacccatgttgttcaaaggtcaactgtattataatttattactacagcaatcctcttcatttctgggaggaatttctgaaaaggtcagatttgcttcaaaattccccagctttttcaagtacctacttattatatgacagatgcttcaaatacaggatcacatctacttttcaaataattctagaaatctcatcagggaaggttcaccttcttcactcaatggcacatttctgcacttccctttgcaataacctctaatctcagtaggttgagatttttaccctatttgattcatggtcaaaattttaacttgtgagtctttgttactgtccacataactgaacttacctgaagacttgtgcaagtgccattaggcactttgcaaacaaggattttcctgtggagaggcacacagacaagagatagcagaaatatagtttttttttttctttttaaatcagagctagcatgtccaaagaggaagcgtttttcacctccttggagggctccagggtttttagaaattctgcttcagtagatttttttttcctacagtggtttacatggtctttctgcatctacaagctttgatgtttgaccacctaggtaagcttattaacctgtgtgtattcagtggaaagtctaataagacattttattaaaatcctactcctatatctagatgctttcaaaaaccctttatctaactttacatttcagtaacaagaaggaatacgttgtgtgccaaatcagagcctgcacccatttggaaaagtttcagagtgtattttgactctcaggcatataaccaggcatctgaacatcactgtccaagtgaacttttatgtcaaagaggctgttgccattagaggagttccagggtgagcaatgtgacagccaaaggacgttttcaggaagcaggcatgctctatgtcagggggaaggcaggtgattctgggccattccactgggagcaaggcacagttttcagatgatcattttcacatgcttactttaggtcagcttttagtgccttgacctcagcattcttctttttgtcaccttagagacattctgcaatacttactacaaaaatgaattacaagtcagaagatagacctcaagctggggagaatgggaatagcgtggtctctagatgaatcaggccagggatctggtgccaatctgtcacttactaactatgtgatcctgggaaattactaagcccagtgagcctcagtttctttatctgtaacatgtgtttggtactttttataatagactattagaatataagacatttattaaaacacttggcacagtgcctgacatacattgcatctttaataactatcatttatttcttttttttttttgagacagagtttcactcttgttgcccaggctggagtgcaatggcatgatctcggctcaccgcaacctccgcctcccaggttcaagcaattctcctgcctcagcctcccgagtagctgggattacaggcatgcaccaccacgcctggctaattttgtatttttagtagagacagggtttctccatgttgaggctggtctcgaactcctgacctcaggtgatccacccacctcagcctcccaaagtgctgggattacaggtgtgagccaccgtgcccagcccaactatcatttatttctaacattattttgaccccagattttggaaaatatttttgttttccaggacatctcagagaatttgcagttgaatgggaaacagaattatcactaaaaaatgctgcttagtaaatgtcccttgaagaggattcattatttaattaggtgttggggagtcttccatagctgagtgcaactcactaactttaagatcctagaatttgggtcacaaactcctttcttccctcccagcttctgtttcaaccaaaccactatttttcattcacctcattcatatcatccccaccaaaagtatagccatttcagtggagtcagctgtacaccaaaccaggcagaagagtacctggccagtggcttctggcctcccttcctgagagattcatgcttatctcaggaaattcttgcagatggcagatgttgggtatcagtcagccacctcttacactgtgttcgactacactgggacaaaagtgcaggacaccttccattcctgcccctggtggagactcctctctgctacatccaccacccaaaaggaacttctcagagcagtttttcattccaggcttttctctaaccctctaagactcatggtctgagattgtggcgcttgtcagcttcattataatcaactcctcaagaaggaactgcggtttcccaaagatcaaaacgcccagctcagggcatttaacttcaccactctcacctggagccccacaccctcacccctctcttacttttcctctgcatcttagaggacatctcgccaccttaattacatgaatgcaactcctagactctactactctaagggtaggggtttctctggcttattctagtaactccactactaacccagagccttccaaagaggagatgctcataaaagttgtggaaagaaagactcagtgagcaggtcttttgtttaagttgtaatttctcctacaaccttcaaaaagcgaagcaaatccagttatatgtatatgtttcaatttttatagaacaacagatgaaaatggataaaaaggctagaattagcagacttttccttttattttatggccccatcaatcttattgataatttcttacatttgccaagaaaatatctattccaatgccatggtatattgttataagtcacaaagcaatatggaaggtttcccagtatgtctcactgaaggcagcagtggccagtctggagtggatgctaccatcatatgaactacaacagggaggtgcagccagggctgcacactccttggaaccagcatgaggcagggacaagtgggagccctgccccttccgagttggtggggtgggagctccccgggtgcagccacagccacccaagtcgcagctttggatacaggcctcccgcttcatggagcagacaggagcctcactcccctgggtgcagctgcagctacccaagtcgcagctttggatacaggcctcccgcttcatggagcagacaggagcctcactcccctgggtgcagctgcagccacccaaaccatcgctgcagacccaggcatcctgctgcatggagcaggcagaagccccgcccccctcccctgggcacagctgcaaccgcccaaaccatcactgcagattctggcatacctgccctcttgggggcccaggaaggcccccaccaccctggcagggtcagaaatgcctgctcctactcctggcttctccctgctatcagcaaccactccagactcagagcaaagttgggccaagcccaggtgctgccacagcctggctgggtgtgcacacactcagggcagtgctgacatgtcagtcccctgctggcttggacccctacggaatttgggcgccaatgagcatagtagggaagctgatggggtggtgagggcagctcataactggcctgtaggcatcccttggcacctatggcctgggctctgtgaatgacagcaggaggcagacaggttcctggtcagaaggcggcgagtccctggtgaggccccaccttcaggccggggagggcctgaagtctgggggctgggctgccagtcctgtggaccagagtgggaacttgtggtgccttttctgggcccacccatggccaccgatggaccaattggcatgcactttctcccttctgaggcccaaaaatccccaggctcagccagaagtgagcagatgtcgggacaaccagcttcagagaggagctatccactccagggcctcccctctgctggaagctgcagagatgggaggacctgcctgcagagagaagcttcccactccagggtctcctctctgctaggagctgaacacttgttgggacaccctgcctgcaggaaggagctgaccccctgcaggagactaagctgttctattgctaattaaagctcctcttcatcttgctcaccctccatttgtctgtgtacctcattcttcctggtcacaggacaagaacttggaacccattgaatagctgagctaatagagctgtaacacaaacagactgaaatatgccccttgctcaccatgttgcgagcaaagagaaggagataagacctgtggcccatccgggagcccagacctgggagctccctgagccagggctgtgactccctctttggggccttgcagttcctggcatctccaagcttctaggtgccaccatgttctgcagtgccagctgtggaagctgcttgtggtgtgcctggtccagctgcaggtttgtggagagccaacacctgtgccagtgcctagagctgcctgccccactgcagcagctggcatgtcggactgtgtgcagtggctggaccccacagtcattcacacaaccctcaccattccacgcctgactcgcccttggcgggaattggacacagactggtagtgcgagctgagtgcagcatgccagattgaatggtcaaaacaagcccaacaggcccaagcaaaattcaggcaaaggtgccagtggccacagaggtttcttgccagaaaaatgacaccccaaaggtcccataacattacaaaataacaaactcttatacatgaaatggattagtaaaaatacatgtgtgattaatatcattcataaacttagatgttaaaactaattaaatcttctgttaaaaggaacaaatttgaaaattactaaaaggaaacaaagataaatctccaatcactcaatagaacaggaagccaaagatggtatgcaatgtgtttccttccacccaccttgacctcccttaccaagaactctgactactctgttcaaatacagggtgaagaaagggcctgatttcacatggggtaggttgtgcccctggaacttgcactggccctgtccctaaacctgccacctggtggccctggctgcaacttgtactcatactccctcttccccctctcttaaagcctcttcttacagagacgggtaggaggtgggatctgtcccatggaccttggccacatactccaggactttcatcttgttggttttagtgtgggctcttggactctacaggaactcatagtgtgcaggatcactgctgggcacctggtggtactccaggtagttttcctgcacccagtcttgggtgagcagcttcctgggcttcccatagacactgtgcttcttcccagcatacagccccatcacactcagggtttcccatatgacctcttcaggggtgcagttgccctccattataatcgtgcacaggaccattatctggaggcctgcattgggcttgctctgatcatcacccagcaggccgtcataggagaggcccagggaagtgacaaggatgtaggagtggccagtggtatccacttccttcatgtcaaaaaaaaaaaagaccagccacatgcacttgaagatcacaggaaagtaatccttataatttttgatgacactctctagcatttctgcctttgtgtttgtctccttgactcaatacttgtagagcaggaaatgaaccaactcagtcaccttcccatcaagtgcttcttggaacaaggtcttcaggtctgctgggtctggtgaggtgcctggagcctcctcttggctgctggagccctcattagattggctccatagagtgttgtcaatggtagtgggggaggtagaggttccctgaggactctggggagaaccaggtgacccagcagcaggcagcccctccagggtgcccactgtcagaggagaggagaaggaggcagcctcctgttcctcagccaagggagcctgcacacccaccaggcccaaagcctcgtctccttcggcctcaaggctttcctcaggctcgcagtgctgattcctctgctcaggagacatgatgactctggtcagaatggcagagtgtgggcaggagctgggcaagtgggacccacaggcctgaggagagagggagccagtgagggacctcagctgagagccgaaccttggaggctctaacaaaagcagacttatggatcttttcatttggtgctcctctggggcctcctggggcacctatcctcctagctggcctgttcaccgagaacttggaggaagtgagagtgttacagtgggtagctagtcaggtatgaatagggaaggagagggttcccccagccccttcactcatgtgcacatgcatgcgtgcgtgcacacacacacactaggaatgttgggtgaccattaggcgatggtcaagtggttgttaactatttctgtaaagtaataattgttcacagcccttgccaggggaaggcagtctcctaatagaaaacacctgaaatggatcagcagcttcccaacaagatctcaggactggggagaaagtaacacaagatctctgaagtaggctgatatggtttggctgtgtccccacccaaatctcatcttgaattcccacgcattgtgggagggacccagtgggaggtaactgaatcatagaggcaggtccttcccatgctgttctcatgatagtaagtctcatgagatctgatggttattataaaggggagttttcctgcaaaagcttttttttttttttttttgcttgctgccatccatgtaagatgtgactttctcctccttgccttctgccatgattgtgaggcttccccagccacacggaactgtaagtccagttaaacgtctttctattgtaaattgcccggtcttgggtatgtctttatcagcaatgtgaaaactaatacatatgccaacataaaaccccaagtcaagaggtcaagctgtgactttggtttctcaagttgactacttggccctcttccgagttatacttttcttgtttcctttccttcctttccttactgttctaaagctttgtgttttgtttgtttgtttgtttgttttttgcctcagtctttccttctgcctttggcccctcagtcgaattctttcttctgaggaggtaagaactgaaattgccgcagacctatatggatacaccaccagtaactcagggtaacttgggtacctgccaccactaacaagagggctcctcagggtgcagcttgtcagcagaagccacggctccagcaataacagtaggacaggtgggttggcactttggagtcccctctgctctggggccggtggagccctttgtatacatttaaagtaaacacctcaccttgcctgctggcaatacctgggcctcctctgctgtatgacttcaggacactgcctcagaccaaggcccaaacctctctgagacctgggagaaagaagtgagggggcaccacacggaaaattctgcacgggattcccaaggctgacagaaggagcaggtttcaggggtgcctcctctgtctgcgttcctccaggtattcagatttattcccgacagggcccagccctttcgctcctgctcaactgtggatgagtcttgtgtgccaaggccaccatcttcctgggacccccaaggagaaagtgggggaccatgtcccttctccacaggcctgccttgggcctcccaggactgatagcagaggcagatttcctaggtccaggataacaggtctgctgagtcctctctcagggctctaggggacttctctctttgctggcctgaggccctactcctcatattacacccctctcgtcactggcaccccaaagacacagcaaagatgtgccacacacagccagcactcccaggacctcccagggtcgaggtcctctgagtcctccctcttcttcctcctcttgatcctgtcagggctgagcctcacccctttgtggacctgaatctatatccctcaaattcccaaggccaattgagaaggtgcctcagtctcagaaagaagtggagtaggccccctgttctgggttgctgggtcccctcaggcctgccttgtctcccagcctggcctggacccaccttctgctcccctgaggccgtgctcatgattccaagccccttccctccatcagcccccgatgtgaacatcaggatccacatgcctgtccaccatgcccggaacttcccagggctgacagcagagatggagcctcgctctgtgggatctcagccctccttcagggtctggaccatgatgcctggcaggcagagcatgggtcctgccctttcctaatcagcctttccctggtcacaccaagctctgtctccagaatgccctgcggcttaagtggcagtggagccgggagcggcccagcctgagaagtctgcccccaggtggcccagggctggcagcaggggtggcactgggttaattggggtcctctctctggggtaggggcatcctcagtcttcctcagtgtctcaccttgcctcctcacagagccggggcctgtttcactccaccaatctcaagctgccactcagagcgaggcgctcttgctatcctctgacccctgaggccacgtcagtggcgtgacatccggcccccaagcctggggcttccctgggtcgacagcagcagcggaactggattcttccaggcatgggggtaggaatggttataggggccctcaagcttcccttagggtcctgacattgattccttgcagagcctggacaccctgccctctgccaattgggtctgctcccttcacaccaagtctctgactcccagtcccctgaggtggcagtggtgggaggcgtgtgttcagggcgacaacattgccaggatcttccaggattgttagaaggggctgagctggattctctggttcctctacaaggggagggtggactctcagtcctcactcaagaggatcctcctcctggctcttggatctttgatgaagccatgggcaggagatactctgtttctgccacttctgagcatttgcccagctgcatctcttgcagagaatggctgcgggtcccaggccaggtactccctgcagagcggcagcttctgtgattgtagtgacctctgggagaagacacacaccttcccaaggaagctcttccccagccacaggtcgagtttgcaaacctgttttcctaaaatatttgtttttacattaaataggctgagcagcagcatgaaatttggggattcctgccattagaattatcgagtatttcatagctcagtgcagtgattttcatttttaaactttcattcagcatcagaaatcatacttaacctcattatgcctgtttcattctaatgctcaacactctatttgtaatccattctttatgttcagttaagccaattcacctattaatgtggttttaggtggttattagcacagactggagctactactgtttcaatgaaaccagactactggcacctgtggtctcaggtgccacctgacattttcacactggaataggggcaaaaatttaaacatttccttctacacatcctgtcatcttccttctatgccagctatggactctccctaacttccttgacactctggccatttcgattacaggtaccagttaaacacagtcttcattctcccccagggctttgctttgttgtttagattttgttgttgatactatttgtttttttattttattttattctttcttctatagttttccaggattgattttggtagttgagggcagaagtccaagcctgacattcatcttggcagctaaattttaagcattatatctgtaaatcttgaataagaaaaattgatatcttttcaatagtctgttccctattaagggatatagaatacggctctgtttatctgggaactttttgacctaactctatcagtacttgcatagttgtttccataaagatcttgtatgctttgtctgtctccattggataatttctagattttgttgccattgtgaatggggtattttctattacttgttctgaatagttatttatttgggttgcaaggattttgattttactgtagtaatcttctgtatactatttttctgaagtctgttatttgactattccatctgcacaattctttgaattttctagataatcatattgtcgtaccaaatattaaatctgttcaatatttatactgattttttttttatatccacctctctggccttatgttacagtgtaatttccaaagatagaggttatagcatagtcct

SEQ ID NO: 629 - DNA, 51985 bp, Homo sapiens
catacgaattttacttctcctgaccagttcttgattgtaggtttctctgcagagtctatgcacagcctttcttccccgttccccattctgtgatgagattctcctttttactgaagttcccttcatgggtggaatgttagatctcaataggcttccttgttttctcttgctcactatgggaaacatgtactcagactgcttcatcaactgggatctacagaggatgaagggcagaaaaaatctttcttctcatttgtggaaagctctcaaaattactaatcttttttttccctgacagtatcttatacgaaaaaatttggtcttgtttagatatgtttccttcacgtcacaacagaaacagttttgaacccaatgaccattctccagatacagcactgtgaagttgtaggatgagtgactgaatattttttattatgaatgttttatcaaagactttgggcagaagtgattattcccatctttaaatatggagtatacttaggttcccttcatttcttctctgctcccaattctttactatacttttcactttttaagggtagctatatttaatacataaaatatattgtatgcaaaattatacatcaaacaacagagaaaataaaaccgaacaaaaacactagcatgaccttacctcccagtggcaatggaactcttctgcctttagtctccatcttttttccatgcatttaatagtggaatctatactgtgttctctaatttctaccttgccacttatctttctatctctgcatccatctacccatttattcacagttaatttcaaccaaatgcccagtaactgaagtcacagtttagaagcatgacatagatgccaccaccagcaagagtgtaaatgggtatggctttttttttttttcttttgagacagggtcttgctacattgcacaggttggtctcgaactcctgagctcaagtgatcagctcacctcggcctcccaaagtgctgggactgtaagtgtaagccactgcgcctggccaggtatggcttttggaaaagcaagttggcagtgcagtatacgtatataggaatctcaaatagttcccaacctctagctcagtaacactatttctggactatttcctaagaaaacaaccaaaaaacaaaaggcaaaaattttaatgcataaacatatatactgcagtatgatttaaaatcattcaacactggcaacaatggaaataccatattttagaaataagaggatggtctgatacatgcacttgaagaatattttgtatcaattaaactttagaagtcatgtttataaagaccttttattaacatgataaaatgtttatgatacaacattaaaacaaaaaaatcaggatacaaaatggtgcacacagttatatccaaactgtttgtataaaacacagacataaaaacactaaccatgttatctccccatggtgggattatgggtgactattaggctattacttctgcttgtccgtcttttccaagctttgtacagtgaatatgaattacttttataataaaaaagaagtttatttaaggattttaaaagttacatacaagccagggccagtggatgatcttgtccagtcttaaggcaatgaatataaactggagaatgttgacagaacacaggatttctaactaaaaatgaagagaagaatcagttaaacaaagtataatttgcatttaatactgcagtaatttggttaacacactaaaagacaatacacattataatacagtgtaacttgtataatattatattgcactggaaactcctgattttcggtaccagaggggcacagcagtattatggcaaggggaaatggggctcagcctgctgccttgcccctctgctgccttgccctttctggcctgaggcctgagcacagatgagaaccttgtttccaggttcactgggaacacaggctagctgcaatagaccactaaacttccttcatgtccctaccaacaatactgtctactcgaaaccatccttgtgcatccttcttctcatacctcggttttgcccttggaccccaccccttcctttcaggctccttgaggaccttgtcacatcaagccatcaactgtagattccgtactgtatctttaaccccacctattccattgatccctcctagcagcacagaaatgactccttctcattaaaaacaaaagccccgaaaccagataaacccaccccatcctttgatccaagacccctcttagcctcaggtttctctctgcgagacagtaatgaatatgcaagcccctactatctcatctaccattcccagcttccttgtgatctggcctccacccccatgaccaccagaagacagctttcatcaaagtcaccgataaccgggaggcagcaaaaacacttcaactggcatcctactgatactgtggatgactctttcctttttgctcccctcctcctggccatctagatcccaccatacagtcttggagccctctggagtgttctggtaattccttctgtctccttttccccctccttaaatggtgatgctccgcagagccacaaactcagtcttctctcccgactaggaagacagacacacaaacacacatattttcactcacccgctgcaccctggactgggggagaagaaatttcaaccagacccttggtctgcattattacctccttcatggttagttctcacatctgtctccaacttagccttcctgctgcatagcagacccagctgtgcataggccactcggctctcctaaaggcacctcaaatgaagccagtcccaaatagagatcattatcgcctgcacttagaaccttgtatctcctctttctatagcctcccatgtcactttctatggcctcccatgtcactatggcctcccatgtcactttctatggcctcccatgtcactttctatggcctcccatgtcactttctatggcctcccatgtcactttctatagcctcccatgtcactttctatagcctcccatgtcactttctatggcctcccatgtcactatggcctcccatgtcactttctatggcctcccttgtcactttctatggcctcccatgtcactttctatggcctcccatgtcactttctatggcctcccatgtcactttctatagcctcccatgtcactttctatagcctcccatgtcacttggaggcacaacagtggtctcatttctcaagccatgagcccgggaatcaccctgcattctttttcccacactgtcacgttcagtcaccacatcctgtccactgtaaagtccagatttctcctgaatcccgtgcccacttcctatcctgatgatgactgcctagtgaggccttcttcggcaccatccgcctaccacttcagcaaccccttactaacctcccgcctccagcccaaacgccctgcaggctgctcctcactctggtaaagtacattcttgcccacaaaattgaaatctgggaccaggcccagagcttcccaaaagttctcagtacataggtacatggggaatttagtaattcctccatagacctctaggccaaaagaaatccctaatgtggctgggaatgccaacagttgcactgatttaagtaattacatctaacttagtaagtatttctaagtagccactagaaaaaataattcatataaatctaaagaaaaatgttaatattattcttaaataaccaaaactaattcccagtgggatgcgtgtgcctgtcaggtagctcaccatttcccacgccttggaatcagacaaggtgctcccactcgttacctgttcttcacccggattttcacacagcattagccttttttgttttcacagcaactgctgaaaacccagcttcttaaagatacgacgtcactgaaaggaatgcagtgtggcctaaaaataaacctgtaaactatttcaagctagtagtttgtatggtgtcccaacaaatgtcaggtattactgttttcctcaaaatgtccactatcccctggtgccctgtgagtgcactggggtgcctggggcacttcagcacatgctctgtgggctgaggacgtggcccctatttgccccaatccctctgtagaggctccctctcttctcaactcccacagttccttcctttccaccttgtgctcccgtcggatctgaatcgccacagtccactcagctgatggagtgtttcctgcctctaggcttcaatgtgtcccaaaaatgccatcccttccctcccaacacagggcttcctggcagaccctcaactcctccttcccatctctgtatgagcctactccagaccaccccctcaccaacataggtactgttcttgcatcacaggaggagggagctcagctcctggtatgttgtttcttccaagggcaggaatgcctagagtgtgaatatatgaaagacttactttctgtaattcaggcccaatgcagtcctagtccttgtatagttgtccctcagtatctgtgggggattggttccaggaccccctgtggataccaaaatccatggatgctcaagtccctgatataaactgggaattgtagggagggtgaaagtggaccatcagatactctccctccacggctcactcctacctaccactatacccatgctgtggcctttccaccagcatgaaaatcagggaatagctccccttgttcaaggccaaacccttcctggtgctctaggtcccattctccctgagtcccacagggccttgctccatcaccgtccctctgtctacataccttcccctcacgcccatacctggggtctaggcttatatgcctgacccaccctacagctgctatgtttacttcctaagccaactgcagtcttctcccttcactcttcatccacacggctcaaaaccaggcatctacagcctctagttctcccctcaacccatcagtattcagctttgggccctcagcttctatgcagttatgtagttatgtgcccgggctttagagtcgggctgactcaaacggaatcctggtcctgccccttcacatgtggccatgaacaaatgacttatcttctctggacctacctcacagagttagttagtaagaaaactaccacatgtaatgtgcctcgcacaatgcctggcacacagtaagtgctcaataaacgttatctgcaattactttcattactattattactagtcctggtattttattcatctgcatatcctctatgcttagggaaaaagggcttggcatctagtaaatacttgataaatgtttattgaatgaataaacaaacacaggggcacatcaggataagctaaccagacagcaggggaggtgctaaatcatggggtctgaggtggggagatggtcagttttgagtgtcaacttggctgggctatagtacccagttatttaatcaaacactaagcttgctgttgcagtgaaggtactgactttgaataaaggagactaccctccatagcatgggtgggcctcatgcaatcaggtgaaggccttaaaagcaaaaactgtggtttcctggagaggaaaaaattctgtgccaggactgcagtgtcaactcctcctaggtctccagcctgttcacctgccctggagatttcagacttgccagccccacagtaatgtgagccagttccttaactctctttatacatatatctgtatctaacctatcagttctgtttctgtctgattgatacaggatgtgaagctgggagaaggctgatgtcctgggtgaaaagctagtgttctaagtgaagaaagaaaaattgttatttccatcatcttttgttgccttgttgtctcatgatgtagagttggtaatgatcaagctcttcctaacaaagggtaagaaattgacatctgaataactgagcaaaatattttacttttgaaaacattctttttttttttttttaagacggagtttcattctgtcacccaggctggagtgcaatggttcaatcttggctcactgcaacctccgcctcctgggttcaagagattctcccgcctcagcctccggagaagctgggattactggcgcatgccaccacacccggctaatttttgtattattagtagagatggggtttcaccatgttggccaggctggtctcaaactcctgacctcaagtgatccacctgccttgacctcccaaagtggaaaacattcttaaatatatgaaatctcacctctagtgacctgtcatgtcgaaagccccaaacgcaagctgcaacagacaccggggaaacaaagaacagcggcatgaagaccaggagccagaaatggcttcctctctcgattctgtcacagaccagaacttcaaacatcaacaagagcaagtggatgcccactgcaatcaacatggctttaaactccacacacgtttctccttctgctctaaaaaagggagagaagaagaaaacaccctcagttcagaatctccactataagcaagcagttcagggcaaataccaacttatatttatactttgaattttacttgaaaatttgacaaaagcaaagggaaatcaggtagaaagctaacttaaacctaagctttggtaggcaatctctgaaacatcgaagaactactacataatacaaaatgaacattacaaccaaaccagaatttaatgttttaaccgtataaggatattctcaaaagtaatagccagttcttatttccctgacaatgtacataaacacttctgttcacatctttaaattcaacaacaagagttacttccaagattattcaagctgatttgcttctgctgctaaaaccaggcaaataccccttaagtctcatgatcctcatttttcaagaaaccatgtaaaccacccttcacacaatattataaaaataactctagttctatgaacaagtgccagttatatttcaagatagtagtaactattgttaggtgctatttttaaatgcaaataaaacgtataaatgattttcattttcctttctattccattaagataaattaacacctgcacatgaaagagaaagaagaacaagagttaaaactgttctcaaacaaaatcagtttaattagctaagtatcatgcacaataaccttaacagatctacaattgagcaatggtaaggccgctaatcaggaaaaggctctataatgcatctgaaaggcctacaatgtttattcaaaatacagatgaacatttatgatatacatgtattgtgggtgacaaatacaccggaagttagatcatagagaaaatgctatcagaggttattcctgtaggacccaaccatgttccactggttaatgttaacatgagaatgaccacgcctgtacattccttacattcaaccccacatacacaattcctttccttgctcaaaacatcttaaataagaccaacaaagagaagtttgaatatattctaaatatcaattagtagaacctaaatgtttatttaactttgcattctttgagaagcaattaatattagatatctgaaaatatctcataaaaaaataaaacacatacagccacacaggtcatcaatctttcaaaaaaaatctaagaactctgaaacagctatacatgaatgtccctcacctgccaaggctctctgtgtaactgttttacagttcttagacatgtatgtgatatgtaatttacacaatctgaatcattttcatatttagtaaacaaaaatttaaaaagttgatgtagtggccggacgtggtggctcacacctgtaatcccagcacttcaggaggccaaggcgggtggatcacctgatgtcaggagttcaaaactagcctggcatggtgaaaccctatctctactaaaaatacaaaaaattagctgggcatggtggcaggtgcctgtaatcccagctactcaggaggccgaggcaggagaatcacttgaacccgggatgtggaggctgcagtgggccgagatcacaccattgcactccagcctgggcaacaagagcgaaactctgtctcaaaaaaaaaaaaaaaaaaaaaaaaaaaaaaaggtgcggtagtttcaactttacacttttcccacatgagcagctgccttctgggaattcctgtactcctcattttcccagtggaggttcataatagcctcccagtcttaagtccccctttttccctttatgtagttacagtctctgtggcagagaagggaaagactctcgcaggtcccagcaacaagcaggttgcatgctggcgtgagccaactcccaggaatttgggccagcggaggcatccaagagcagggagggcaagagttggaaacggtaaagggtacccctctcccctgcccccaaaggctctgctttccttctcggcatccaatctttgactttcctcattccccagctgctgtctcagggactcatggtctcctggtcaagccacctcccctacactgctaatagtcctaaagctctgggactaggagggtgggacaaggggagccccagttccaaaactgtattggagaaagatctttcatgaccaaacataatatgagtgtcttttcctaaaaacagggtggtttcatgctgcttagtctagtatggcataccagttctgtattttgggtgcattttggattatataggcatctgtgagctggctggcaacttacccccaaatggcactgcttttgtaagaaaatacataccaaagactaaattttcaaaaacacagaagagatctgttagcttatactatagttctaagaccccagataggtagaaaataaaatggtccttacttcatcaaaagtgagaaaagtcaagatattgctccctcatgctagagaccaatgggttgtataaagcagtattaccgatattgaggatttcgtgcccagactccagttccaactgaggctccaacaatgaccattaacttccacagccatattggagcaaagacagcccagtaactccactgtatgatgccatccaaacgaagggccagcagcacagagaacagcagcagacaggcatagatgaggaatttactaggagaaaagtaaaacgattaagaaggattcacttttacaaatatgtgatactgaaatggggagtaataagagccacatttgtcagcatgtaaaaggagtcactaactcaataatcatttattgaaaaggtctatggggcagacataatgtgttgggaataaaagaaacataaagaagactaaaataagtctcctgctttccaaggcttcctcatagaaggaagaccacacagaaacatataatacagcacaatgtttgtgatgagagcttggaagaggaaatacagactgtgtctgaggaggcactcagaagcagagatgtggtgaccctagagctggttccagagggcaagtaggaagctgccaggcaggaaagcaagtgagatgaggaagtattccaggcagaaggaactagctataccaagacacagagactggaaaaggctgacatgctctgaaaatggtcaagttctatcactaactgattctatttctaaaaaggcagccatctgtcatattcatatggcatgaacattttagtgtatgtattatactttccatgaatgaataaattacacatacacacatgctcacgtctcatataaaagggaattgctacagaggatgtccttgaaataattagaaattatactcttgaggacctctatttccagccttgacttaataataggaatataatttaccttcccgcctaaataagaagcttgatacagtctacaaaagaacagttttcagacattgacaacaggcagtggagaacaggtgagaaggaggaaataaaggaggtaaaccctactattgccccagtttgcagatcagaggcagtttccaggctgcagcaagaaaacagttaaaactcaaccctgtcaataactatattaaatataaatggccaactgaaagacaaagatgatcagattggataagtaagcaagacaactatatgctgtctgtaagaatcccactttatctatctataaagacacagatagattaaaagcaaaaggaaagaaaaagttataccaaataaacactaaccaaaagaaagctggaatgactatattaatatctgtttagtcttccattgctgctgtaacaaattaccacaaacttagcagcttaaaacaacgtaaatttattatctcacagttctatatgacaaaaggcgagacgggcttggttggtttctctactcagaatctcacaaggctgaaataaagatgtctgttggtggaatgcttatcaggggactctggcagaatctacttctaagctcattcaggttgttggcagaatccagtttcttgtggttgtaggactgaggtatgtgtctctttgcttgctgtcacgcagcagctgatcttgcgatagtaggggcctctcctgggtccttgtaaataggcccctacatctcaaagccagtaacaagctatagcatattcaatctttctcatgcttgggatgttttctcactacttctgccatatcgcttctgcttccactgagagaaagttctccgcttttaagagttcatgtgatgaaactgagtccacctggttaagccaggctactctccctattttaaggtccataactgtggttggtaggcagaattctaaagaagtttcccaggattcctgtcccctgattattcaatcaaacactaatctgagtaatactgtgaagggactttgcagatggaattaaggttactaatcagctaactttacaataggaagattatactggattatccaggtgtgcccagtgtaatcacataagcccttaagaaagcagaagagtaagtcagagaaatgtggtggaagagagatgaggcagaagtcagagagattccagacttgagaaggattcagcctgttacttctggctttgaacatggaggtaaggaaccatgagccaaggaatgcaggcaggcttcagaagctgagaataactcgcagctgacagccagcaaggtaaatgggacctcagccctacaaccccaaggaactaaattctgacaatagcccaaatgtgcttgaaagcagattaatccctggaggctccagaaaggaatagagccctcctgacactttgattttgaccctgtgaaactaggcagaagacccatctgagttgtgctgtacccggacttctgacctaaagaactgagagtaatttgtcatggtaacagcagaaacgaatgctaataaatatagcttcaaagtcccctttgccatgtaaaataataacatattcacaggtttcagggcttagggcctgggtatctgtgtatttgtgggggtggggcattctgcctaccacaacataagacacagtatatttttgaacaaggactatttccagggacaaatagaggtagttcataatgataaaggggtcaatttgtcatatgcctaataacaaagtttcacaatacatgtagaaagtactgatcaatctaaaaggagaaataaaaaaatcaaactgttataaatggaaattaacattcctttcttagtaactaatagaacacataaacagaaaattactaaggatatatatgattgtagcaacactatcaaccaacttgacctaattaatattaatgagttcctcccaacaaaagcaaaatacagattcctttcaaacacacacggaacattcaccaagatagattgaattctgggccataaaacaaagctcaacaaatttaaaaggactgaaatcatacaaagtaaacaagcacaatggagtcaaactagaaatcaacaatagaaaaatatctggaaaattctcaaaatacttgaaaattaaatgccacactgcgaaataatccataggtcaaagactatgaagaaaattgaaaaatattttggactaaaggcaaaaacacaatataccaaaatttgtgagatacactaaagcagtacttaagggaaattttagcatcaaatacttacattagaaaagatatcaagtcaataatctaagattctatcttatgaaactagaaagaacatggaggtaaggaacctccatgtaagaaacggaaggaaatttgtaaaaagtaaatggaaagaagaaaatgataaatgtaagcacattaatcaataaaatacagtaaaaagggattagagaaaaaaatcaatgaaactaaaagcagtttctttgagaaagtaagaaaattggtaaatctacagccagaataatcagtaaaaaagagtaggctcaaattactaatatcaagaatgaaaacagggatatcactacaaatcctaataatactaaagggataagtaggggatattataaacaactttatgccaggaaatttcttgaaacaaagacatggaaactgcaattctagttaaaacctttttcagaaagaaaatgtcaggccatggcaaaatctaccaaacatttaatgaggaaataccaccaattcttcacaaactcttgcaaaaaagatgaggggggaacatttcccaatttattttatgaagccagcattaccctgataacaaaactgacaaagaaagaaaactacagaccaatatctctcatgaacagagatgcaaaaatcctgaaaagattttagccaactgaattcagcaatatataaggatactacattacgactaggtgtggtttagctaggattgcaagattgcaatcttggattaacatttgaaaatcagttagcaaccttcgtggtattagcaggctgaaaaagaaaaatcatatgatcatctcaatagttgtgtaaaaagcatttgacgtaatttgctacccattcaagttaaaagcgttaaacaaattaggaaaagaagagcatctatgaaaaacctgcagttataatgcttaatggtgagagactcaatactttccccttaagacaggaaacacagcaagtatgtccacttcaacacatctattcaacattgtactaaaggtcctagccacaacaataagatgataaaaagaaattaaaagaatatagttttaaaagaaagaagtaaacctgtcattatctataggcaacatgatattccgtgtaggaaatcctaagtaatctaaaaaaaagctagtagatctagtaagtgaatttaacaaaattgaaggacacaaggtaaatttacaaaaattattgcatttctatatagtagctatcacaaattggaaacagaaatttaaaaatatgtatcatttactgcaactttcctataaatttataactattcaaaaattaaaagtttatgaaaaaatccaccatttacaatagcatcacaaatataaaacacttagggataaatgtaacaacatatatgcaaaacctatatactgaaacctacaaaacactggtaggactgtggggaagctaataaacaacagaaatttattcctcacagttccagaggctggaagttggagatcaggatgccagcatggctgggttctggcgagggctgccttctgggtggcagatggcagacttctcaatacccttcacatggtgaaaagagagtgagttagctctctggtctctttttataagggcactagttccaaccatgagggttccaccctcataacctaatcacctcccaaatgccccacctccaaataccatcacactggggactagagtcaacttgtgatttttaaagggacacattcagttcataactgccaagaaaaattaaagatctaaataaatggagacatatactgtgttcatagaacactcaatactgttaagatttacatcctctgtgtattagtttcctatgggtgctgtaacaaactaccacaaaattggtgacttaaaatggcacacatttattatcctgaggccagaggtccaaaaagggtttcactgggctaaaaccaagatgtcagcaggacctactccttctggagactctatgggagaatctattacttgtttttttccagtttccagagctgtattcccttggctcatggcccctttctctatcatcaaaaccagctgcataaaatcttcaaatctctgtctctgtttccaccacactgccttctcctcttaatattatctccctcttttaagggaacctgtgattgattgcatttattgccccacttggataaccccatcatctcaagatctttaacaggttccatggaagtgggtatctttgtgggtcatgatttagcctaccacacacaccaaattaaccaaattattttaaagaatcaatgcaatcccagcgaaaattgggagccagcaggttcttctgtagaaattgacatactgactttaaaagtcatatgacagtgcaaaggacctagaatgggcaaaacaattctgaaaaagaacaaagttggacaatttatactacatgctttcaaagcttactataaagctacagtaataaacacaatgtagtactggcataagaatagatatatagaacgtactagagagttggaaaacagacccatacatatagagtcagttaattttccacaaaggtgccaaaacaactcaatggagaaataattatgtttcaataaatggtggtacaactggataaatgaggaaagtacaccttgactcttaaccttataacatatacaaaaatttatgtgacatggatcatagacctaaatgtcatacacaaaactataaaatgtccaaaacacatatgaaaaaaaaatacttgcaacctacggttaggcaaacatttcttagatgggatatgaaattggacttctccaaaatgaaaaactcttactctccaaaagatacctatcattaacaaaatgacagccaagccacaaactgggagaccatactctgaaaacacgtatctgacaaagtaacctgtatccagtatataaaaaggacttttacaactaaaaaaataagtgaacaacccgatttaaaatggccaaaaaattcagagacatcccatcaaagaaggcatacaaaaagcaaataagcacacaaaaaatactcagtattttcagatgttaggacaatgcaaactaaaacgacaatgagataagattacacacacactagatctcttatatatgctggtgggaatgcaaaatagtacagccactttagaaaacattttggaagtttcttatacagttaagtgtatacttattctatggcccagcaatcccacacctaggtattttactcaagaaaaaggaaaacgtatgtccacacaaaggcctgtattcaaatattccaagaagctttattcataattgccactggtaacaactcacacatccataaactggtgaatggttaactgaattttgatatatccgttcaatggaatactaatcagcagtaaaaagtaacaaactatggatgacaacaacaacattgatgaatctaaaatgcactataagtaaaataattcagatggaaaacacaagatagtgtacaatgctacttatttgacattctggaaagggcaaaactctagacacagaaaaacagatcagtgcggttacagataaggaacagaaagctcagatgttaaataacttgtctaagagctcagagttgggagtcaaaccatttgactccaaaatccttctaattgagtattatactataccggctttacactgataaatgaacatgtttagaaaagcatctgtataaatatctgctgagcagctaacaggtctccactcgggaagattaaggatagtctttatactcttttgcttatgatatctgagttttctgtaaggtacgtgtactgtttttgtactatgaaaaataacataagaaacttcgattggaaaaaagggaggagggttgtaagaagactggacctacaaaattaaacttggaagcaagcctcccagagagaaaactacgctgggaagatcatgagattcagaggggttgctaaaaaaatatacatagcatcattgtgtcatggtattcttacccataaagttagggcaataatatgtacctcataaggtggctacgaatataagataatgagtataacaagtgctttgtataaagcactaaatcagtggctctcaaagtttttagtatcaaaaattttgacgtttaactcttaaaaagaactccttttcagttctaacacttactgaggatcccaaagagctctggttgatatgggttatccctattggtatttaatatttacgatacagttgttattcaaaaaatatctactcttcgaaggtaataataaacacattacatactaacataaataacattatttaaaaacatttccaaaaccaacacaaatttagtgagagtagcgacactgtttctacagtttagcaaaatttttaatgtatgatatcatagaagacacctagattctaatatctatatttacattcattctgttgcaatacattgttttggttcaagtatacaaagaaaatctggcctcacagagatctgtagttagaaaagaactattttaatagctctttcagataatggtagacgttcttcaacaggacactaaaactcaacaagtggtagtttcttaaaggttaactatgatgtggaatctgaaatcgtatcaatgacctttttgtactctgctacactgaaatccactggtctctcttatactttcaatgaatcttttatcccagcattattgtataatgcaatgtaggtcgactggaaaatattggtttactgagttataaagatctttcaaatgttgacacatttcatatacaatagcaaaaaaaatcacattacttactatcttcaccaacttcatcagaaatattttaattactgggaggttgtcaagctcatggtagcagatacaacttttcaaaaattctggttttcccatgaaagatcaaattttaccatttacaaaaaataccatgagttgttttccttgaagttttgcttcctgcactttctttttttgtgtgtgtgatagaagcatcttttattatagtatttttgtctttttttttcttttttttattattattatactttaagatttagggtacatgtgcacaatgtgcaggttagttacatatgtatacatgtgccatgctggtgtgctgcacccattaactcgtcacttagcattaggtatatctcctaatgctatccctccccccaacccccaccccacaacagtccccagagtgtgatgttccccttcctgtgtccatgtgttctcattgttcaattcccatctatgagtgagaacatgtggtgtttggttttttgtccttgcaatagtttactgagaatgatgatttccaatttcacccatgtccctacaaaggacatgaactcatcattttttatggctgtatagtattccatggtgtatatgtgccacattttcttgatccagtctatcattgttggacatttgggttggttccaaatctttgctattgtgaatagtgccagttagaatgtcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggactataaatcatgctgctataaagacacatgcacacgtatgtttattgtggcttcctgcattttcaagaaaatgtctgccaaacaccataacacaaataaccacagtcttgtctgtcagttgtccttccaaataaaaatgatactccatgaaaacagcagcttgtaactcaggcacacacgtttttccttgagtcaaccattgcacttcagcatacaacaggcctttatgcattcttcccatttcatcacatggaatattaaactagatgtgcattcaggggtcaagattaaatgagattaatatttttctgctttatcaaggacattcgtaagtgaagctggcattttttttttaactgcaagtccagcacgtggtggtgaagaatccagtgacagaagactagtgcagctggtgccactgtcctgatttgtgctccagcaccagctgtttgatgcactacttttgtaccaccagtgccaatgtcgaccaaggcaaagaatgtcttagtattataattttgactttgcagatacctggaaagggtctcaaggcccactcccaaggtctgtgggaaacagtctgataaccagcgtactcaatacacattagctaataatattaatactcgaaaacaaaaacaggcttttataagctgctacaaagaaagaacatttaaagaaaccaagataaaaatgacttcatcccttagactttggacaagaagagagcctgtgtcaaggtgattcacaagttaatagaaatggagttatcaccacaattacagtacacaattagtagaggcagaagttttctctcttaaagcagagggaaatattccaaaatctaaaaaaatcagaaccaatttgtcaactaaagcctgtggctacaaatataattaccagaaacaatggacttgaaaacagactatttaaaaaagaaattagtggattcaaacattaacaaatgctaagataatgacgacacaggattcatatgtaaattagataacatgtacaggtaatttttatcctaaaggattttcagactataaataaaaagtaaattggtgggggggggtggtaaatgctgtaagctaacttcattatcctctgtaaaacagtttccttatttaataaaaaaagagagtagtggaactaaagaaaagagaagtaccaaaatgttttaaatgttggaaaagggattattttatgtggtttttgacataatttaaaggaaacttaaaattttatgtctattacatgaaaaatagaaaacaagataaacttacaaaaggacccacaaaatataattcatgattcaaatactagggttagaaaaatatacatgagctgaatgttctcttattaatttcctattgctgccattcaaaactgccacaaacctagtggtttaaaaagcataaacctagtggtttaaaaggcataacccttacaattctggaggtcagagtccaatatgggtctcgctgggctaaacttgaggtgtcagcaggactatgctactgaaggctctaggagagaatgtttctttgccttttctagctctagaggctgccacattccttagctcatggccccttcctccatcttcaaagtcaacaatggagaatgcagttcttctcatactgaatcactctgacctccttttctgtctccctcttctatatttaagggccctgtaattacattgggctcagccagagaatccagaataatctattttaaggtcagctgatgagcaaacttaattccatctgctaccttaattcccctttgccatgtaacagaacatattccctggttccacggattaggatgtggacatacttgggggcgtcattattctgcctaccacagctctgtaaaaagaaaggttgcttcctagattaagaaagtaaacctgttacattcaagagttacgcttggaaccaaagtcaaaagtcgaaccaactatcagaaatcagatgacagaggtttagcacgcctggatgaagacaagagcaacaatttactatctttaaaattagataaattagatttcaaagccgaaagtattaaaatgctaaaaggactaataaggaaaacctaaataacaaaaacctaacatgaccatggaatatggaaataattttacaatttttcttttttaaggatacacagaaatattttaattgtgggcttcctcatgctactcttaaatcatgacagataaaacagacaaagttcctaaggaaaatacggaaatgaacacaagagtagatttaaaaaacagcaaggttatatgaagagaattaagtagcagaacgagaaaatttaaaaaacagcaagcttatatgaagataattacgtagcagaacaagaaaacatacttgctttacatatatatagtttttccagggagaaaaaaaggatcatggggcagcaatacacaataaacacacatctaatttacaattgttaaaaatatttgagtgcctgaaatgtgtgagatacataaaaaggagcaacaatgcgttcgctcaagatgctcagactaataggaacagagggagatgatgtatcaacaagtaactacatatggtaaactaggggacttggaagattaatttccctgagagagatgggaagagaagtggaatctgggcaacaagttgggaataaggaattccagacaaagggaataagatgttttccaattttttaaaaattatttttatttattatggatacaaaacagttgtgcctatttatggggtacacgtgatactgtgatgcaagcatacaatgtgtaatgatcaaatcagagtaactgggatatccatcacctcaagcactgatcacttacttgtgttaggcacatttcaattccactcttttagttatttgcaaatatacattattaactatatttgccctcttgtgctaccaaacactagatttattatttctatctaactgtattattgtacccattgctcatcccctctttatcctcccctctccaattccagcagactggaacacacagaatactttctataaatcgtggtgggtagggtgctgcagagacaggagaaagggtactggggggaataagccagaagttggctgtggtaacatggtaggggaatgtgaatatcaaggtaaagtccttggaatttattaataggtaatatggggccactgcagattttctcaacaagagtgacagaagatacatatgagtgtgtaaggtagattgtaatcagtagagaccagaggtagacattttatacaattcataaaaacactgacaaaaaatggatcattttcaatactgatttgttaagcagtttagtagagttactaaaatacaattgaaacataaaaatacctgggcagctgccaaaacaaaactcaagagaaaatgtgttcatttaaaatgtttaagtaaaagtagaaaacaaagaaaaaaaaaaagaggcaaaagaaaactagtaaactgagtttctaagaaatttggggaaaaagccaaaacatgaaaataataaaactaaaagtagaaatatagatataaaaatgaaactgatcagtaatcccaacagctagctttttaaaaaaattaaactacaaagttgatcaagtaaaacaaagtaatacaatcagtaagttcaaaagatgtaattcatacacactcctagttggggaaagaaagaatagtatcttaactatatcaatatatttgcaagcaaagtctaaaaggtgactgcatagccaaaaggaaatatcaagcctgatttgcaaaagaatacacaataatatgcaataatacagtgataagaaaatgtatttacaaaaataacttatggtcatagcctaaactactttgagttacttttcaagaaacattcagaccagattccaagtataaaaatagactgcttaattctccacaaacctgggagaaatgggaggttctggtttaacattaatcactacttcttaaaattcacttttccagttacacctttagaatggatttattccactctcatttgaatctgtagtgttagtatacgatgaatcactaagtagtgctacctgggccaaagctagtatcctctctgaaatttacatggagctttctgctcaggctcaaattccctctctccactttgcagggttgggagaatagggagggagaaaaggaagaagggagggagagagagaatatacttagcaaaggaatgatgactctgaatgtaaaagttctagtatctgttttctgcatatcataagaatgcagctggactctttttagacctatcagtttttttccagtggaagctgctggcttcactggagcacatacacgcgcattaacacatgcctgcatgcacgtacacacgcacaagcacatacacacacacaaactttggatggcacatcccagtctaaagcttgacagaatggctccaaatgacaacctgacatactcacaaactatcaagggaactgcccctcttacaccttattaaccaaatttaaagtcttttagtggagactttagctggttttattaagataaaaaatgtttaagagcatttaaccagtagatacaaaaaagcacaaaagccaaataaaagcagagcccaggccagtaggaagatctgcatttaagttcctcaactgccattcatcagcggtgtggtcttgggtgagttattttcccccaggtctgtctcctcatctgattcctcatatactgattcattaagacaagggtatgtgaaagcactgtgtaaatgatacattttacccattctagctttagcagtattatgaaagacaaaagttctgccacattgtaggtaataatctcatttagcaatcattgttgtcactattaggttggagctgacaaagtatgagtctccacttataaagcatctatctccagagttcgaggcttttgtcttaaattccagtcatcttgtacaggcatgacatatcaggcaaaatgattagaaaactcaagctccatattaaaaagcttaacttctggagtcctaggaaactatctaaaactccttcaatccacggtctctcctgtacaacaaagacttcccagtggtagatgtctatttgtacccaacatccactcattcagcacgtaattcagcacctccaaatcctggccctcaaagaacacagctaagaacaatgtgtgtgtaattatcaagtaataggaatgatacttttaaaactggaaattatacattcaaatgagatttctctcctttaaccagtccccttgggaggcaatgcagtaattccaatggtacttcattactcaaatcatctttgaagctttcttcttggaagcaccttgagaacctgcagtctgatcttctgactatcccaaatggtgctaaattttcactgagggtggattcaaattttggaaatggcaaacagtcagtcagagccaaggttagtgaataagatgtgtgatcaaactaggtggaactattttggttgaaaatgatagatgatcataaagcaatgagatggatcttcttatgtgatatgtaaactgactttaaagggaattccagatgagtaacaaggagtatgaacaatggaataggtgtatacattctctttccccaagtaacctctttgaataacaacactcatttggatgtataagcgccactaacaggtttgttttgtttaatcacttacaatttgtaaatagagggttccttagcatactggatctacaatgtcatggaggaaaggagttgtcacttaactagaactatggcatggcacgcaggaaagagcacaggcttcatgagactgacgtggattcgaatgttgacttagattcttcctgcctatgcaacttcagggaagtcacaagctgtcaagactttaaaataaggctgatacctaattttgcagggttgttgtaaagatcatggataatggatgcaaagcccctacattgggcctggcatgtggtgggtactcaagaagtcacagctattattaacagcaacatcagtaaaatcaagaccattttctgactgtaggtggcttgagaggacagaacaacagataagcagtcacttgagtggtaagtagttcattgacagtactgacagtacactcgtgcattagatactgctttcttaaaaacaataacctgtaaaaactatttgcagtaactatgtatttttaattcatacgacacatatcatctgcagtgctcataccacatggacctcttcactacctgaacataccaggcactatcatgaccccatgcctttgtgtactttgtcccttctgagatactgaaaggggccagcccctccacacctgtgggtatttctcgtcaggtgggacgagactgagaaaagaaataagacacagaaacaaagtatagagaaagaacagtgggcccaggggaccggcactcagcatacggaggacccgcaccagcgctagcctctgagttacctcagtatttactgatcattatttttactatcttagcgaggggagtgtagcagggcaacaggtggggagaaggtcagcagggaaacgtgagcaaaggaatctgtatcatgaataagttcaaggaaaggtactgtgcctggatgtgcacgcaggctagatttatgtttctctttacccaaacaactcagtgtagcaaagagtaacagagcagtattgctgccagcatacttcgcctccagccacagggtggttttctcctatctcagaatagaacgaatgggaatggtcagctttacacagagacattccattcccagggatgagcaggagacagaagccttcctcttatctcaactgcaaagaggccccgctctttcactactcctcctcagcacagacactttacgggtgtcgggctggggggtggtaaggtctttcctttcccacaaggccatatctcaggctgtctcagtggggggaaaccttggacaatacccaggctttcttgggcagatgtccctgcggccttccgcagtgcactgtgtccctggttaatcgagaatggagaatggcgatgacttttaccaagcatactgcctgcaaacatattgttaacaaggtacatcctgcacagccctaaatccattaaaccttgattcattacagcacaggtttctgtgagcacagggttgggactaaagttacaggttaacagcatctcaaagcagaaacaatttttcttagtacagatcaaaatggagtttcttatgtcttccttttctacatagacacagtaacaatctgatctctctctctcttcctcacaaggtacccttcctactctctggtctgatgacaaccctacaattctagctcaaaagtctggctcaaaagactagctcaattcaaaatctagctcaaaagtcatttccactatagactcttccctgcctgctcgagacagaattagtagctctgccatttgtacttctaagacatttggtttctttcactgtaatgcctcatactctattgaattcttatttccctttcatttctgcttcttccactaggcttacgcattgagaggaggactatattcctttatttttgtacttagagcacctagtacatcacttggcacgagataggaatctagatgtttgaggaatcaatgttataatatactttgcaaataactgttagaggccaggtagctgactttagtgaactatattaccagcaatcgcattcctttttcctgcttcaaacaagagacaagataacttatatggactccagaatgtcttctgaagatggagcatacagaagtctccaaacactactgatctcatcagtaccccatgcccacaagttggaacccccagagcaacacttctcagcctttgttccagtctagcacacctgagggatacaccacactcccatcaggagctcacaacagatgactaagaaggcccagcagagttttcacagccttccagtgccacatggctaccagggtggaagggccttctctgaaccagcaactcccccaaagtagcagaaaatttcaaggctccatggtgagtgccgggagcccacctaatgctacctactaccagatccctaccacctacaatgcctcagaatcagtttgcctactctaagaacagggctctttcactgttaggaagcctcaggcattcaaggaaggacttgtttgtgggtccggtacatctgtttcggcatgtcttaacctgcataactaaaaagcaattatgaaaagaagttcatgatcaaccagttcagtgccagatggaaataggtagagtgggtcagctggcagccctgtacatctgagtgttgacacttgtgaatcattctctgtcactatagtttccagagccttgccaacgcagcagtgggttcagacttaccaagatccaaaaggctggaaaggggatctggagccatgacccatgccttgggacccaccaaaccatgacagtgactatttctatgacaaagacatgctcttcaaagtaaatatagccatattctgccttagtgccatgttctctcccatctctccaaagcaatggctgcactctgaaggtgggaagagtgtgagaagaaagagaaccaggccacagaccaccaggaaagcagtgattgaaagcagcagctctagatttatcttataggctctggagagttattcagttatttactccacaaatatttattgagccaggtactattccaagtatgcaggctacgatactgacacagtcacggccttgaccccatggagcttaaagtttagtgggggaggcaggtattaatcaaataagcatccagacagacacaagggtacaaatatgcactatgatggaggagtagtaaatactacaggaactgtagaaacagggagcagtaaatctggtcagggaagtcaggaatgcttcccttagcaagtgccaagtgaggataaataggagttcactaggtctggaggagaggaaaagagagggaaacattcctggtaaagagaacagtgtgtgacaaggtcctggggtaggagggagatgttgaattggttcaaaaatagaggcagggagcaaagcagtagcatcaaggtttgagtccccagcataaggtaacttcctgtgtacacccctcagttttctttctcctatagagaaggccttcctcagcatggaaggagactaaagcacactgtcaaaaactaggagtgctcaggagaggtgaaacactaccagctaaaaaaacaaatctgatttaccaataatacctggccaatgtcctcttgaaatatctgtaaaattaaggaactcactacctctggcaacaatgaatcaggaaaatggcacagtataaaagacctttaaacttttcaggtagaaatacattttaatgcaggtagaattaagagattgatgaatatgttgagaattactataaatctgcttagataccaggtatttcactgtaatttcatatactaatttttttggggggaaaagggctaaaggaaaaaacggttaaaggtagtatcagtgcagcactattttgctttggcaactccgttagcctgtttgatcacttaaggcagtttcttgaggcttctgaattctctgtcaccttgcaaacaagtcactgtagctttctatttgtaaggcactttgtaatcaatccttaattggcctccctaccccactgagagattatactcattctacagataaaacaatagataagtgagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagggcacatacaaagtcacaatgactcacaagttaaaatgtcaccatccctagggagactgcaccctcaacatacaaatactcccctaaaacttcctttcatcctcaacaagcagccaaggcataggtccccagagttggcccccgcagtacagcactgcacagtactgtaaggcatcttaagtgtacaagcccttcttcaccccatgctgagaccgccagcatctaaagcacctaacataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcctcatttttctaacccagttcagagcctccttggatcctgtctaaactttgtggtcacttcacacctgacctctgcctccactccaggctgccctacttacaagtaccaggttcatcttccttgggcaagtcaacatctttgagtctcagtttttctcctccgcagaatggaaatgataaaaacctcttttctaagcgtgttaggaagattcagtgagatcgtgtgcataacacactgcctggtacatgctaggtgtacaaagaatgctgttgctatctggtactctttcaggtgtcaacctcctcaaggattttgtttgcttttggaatccaagagcaggacaagctcatagcaggtgacctagtttaccatcttcactttgggcagatttaagttttcatgagcacaacaatgccttaaacattagtctactatcattatggataatagtcatcctttgttgcaatagcagagtttcacaaatgacaattttatactgtttagccccaagggcagcttgagagaatcacaattgcgatagtcatacttagtcttgatgtatcacctttcttctgagaacgtaaaaacatatcataagtggtaattaagcttcccaacacccactgggaaatggatattattatatgagctgattttaaggttgagtaatccaaatcaagttttcatctgctgaagcaccaggaccctgtcccagactttttcacccatcttcctttcccatcctctgggtaaagtccaatgtgtagcccagaggaggttctcaatgaacactcaaatacagacgaggaattaaggcgcagagaagcttgtataacaggccctgagcgagccagcaagtaagggtgaaggagcacagatgaaactcagggtctagctgaacctgcagcccatactgttagaaagaggtgcttgccagtggtcagattggacagcaccatcttcattaccagtgaccgtgccccaagcaggcatgagaagatggtctgccagttcagacacttgaataacaggcatcactgccctttcaagagcttcatagatagagaccaggcaggctcctcagagtccagaatcttgagggcagacgctactttaatgagatcccagggagtctgggagctgaaccactgctctgcaggcccacaagttcaattttagcagttcttccagagttgaccaggccctggaagctatctagcaaaggcaacaggacactgatgcacaaattacttgtcagtgtgttcttttgctctgacaaggtaaattgccaagaggaacatatgaacctgtctgtgaggaaatacaggaagaactggactttcccaaggcttcacatccccagtcttcaagaggtggattacctggactgattctggaagcccaaccctttatgctactggtgctctcatggggaaaaaaaagccagaaaccagatggccatctggtcctctctccagcaagtgcaaaagaccctactgacaacctgctgctcacttcagagccctcactcagtgtcccaccctagatggaggtccaaagcctcaatgacctgtgtagacagacccacaagtgatcctgacattaaagaaagaccctgggtcatatgcaggcaccaggagtgctgggaagcttaattaccacttattaaatgtttctacattctcagaagaaaggtgatacatcaaggctaagtatgactagtggagaagatgacacccacatcttctccactagcagagtttgactttatcttttccttgacttgccaaaaaattccagggctatcttgctaggggctcccaacattcttcactcaaaggaaagaaatggctctggattgaaaaagtatgacccccaaataagccagacagcatattcttgtgactttggggtgggcttaggttacagtgttccagaagaatcagtgtatatctgaccatggttttaaggactaacttggatttgtaccacccttctgataagctggtggcttgtccaattcaatattcacattggcttcaatgtggtgatataggatgcctctcctctgaagagcaaggcactggtgaagagaatcctggtgaatttagacacttggactggggagacctggcataggggaagaaaatggccgtggaaccgccctccacacaccaccaaggctccttccctggctgcagcagtagaatggagagagtgtggaattagtagatttgaactcaacaccagtttcacccttgctccagtggagggagggccagctgggatccagtcccgtgcaaggcctatgggactataaagagcttctcggaggtcagattgacaagttctttagccaggaaacatggaggtgccagcctgcaaggctttcttagcctggaattcctcaccctaggttccctaaagtccacactttgaatgccaccaattagagaattgctgaagatgctgggaattagtccacctgcagaatgcaatctcctgcttcctgacagaaccctttgtttcaggcaactttagcctaacttggatacacatctgagatctccctgggaggtgggtgggtctggagtctagacagggatttgattaaatacggggctagatttaggggcttggagaactggaggaggagattgcagggaggcaactgaagggaccacagaggtagtagctgtagttctgcttggacttgcagcaacccctatggccttccagagcccagaaggagccacctcctcagggagtcttccctcaggtaggcaaattacagttactgagagagaagagggagggaggacagtcccaaggccccagtggacctcctgtcacccagggtagccctgggagtgggtggtttatcatccctcatggagcaagctttctgctaaaggaagcaggggccatttcctgttggaaggcagaatggggagcctttgcctgggccagcaaaccaccacggtatccctgtgcttctcctctggacctctcctgatgccagggtttccaggaagccttcccggctgtgccacactcctccagtgtgctgtgtatgcaaagcccaggtcaagtgtgtgtggccaagcacacggggcagacaaaaaggcccatgcttgccaaaggtcaccaaccagctgcccacatgattcctttttctccttgttcccaacctgctctcattcctgaatctccactcaatgcttgtctttctccctttctgtttccacactgtatttctgacacattcctctggggccctctgccctaactaatcaaatgtgctcttcctcatcttgccttcccctaatggatcctttcatcttgggtagcctgtaaccttcactcctttagttgcattcatctgacatatgtcttccagagtgtctgctttgtgccgggcactgtggaaggcactgggaacacacagatatgaataatgaaaacacagcattgtgcacgataagcattggggatgagggaaccgctgagctgaaaaaataacattgtaaggtaggaagagaggaaatgaggttccaggcagagtaaacaacagttgtaaaaacacagaagtcagtgaatggaggcaggtgcaccattttggagaacaatattgtctgcaaccatcctcccttcccttcccaccaccccactctgcctacaggcagctgtgcgtgtgctctcagctctctgtgcttggaggagtcagttttggagtcccatgatgcttcccactatgcccctgtattcttggatcctggcatgcagtaggtgctcaggcaatggtcatgaaatgaatgctgatgttggacagtcacagggcacaaacaaaaaagcagttcttcctcatcccttgcctcaaaccaggcaacttgtgtctgcaggaaaaatgaccctttctttccaagtttctaatagctgcagacattatgtgggtacccacactcccactttcctacaaatcattgacatgttgaggttttttgtgtcttattataaaacaacttataccatgcttgtacagttctaagatgtgagatgaaccatctatttaataacagattttcaagggtaaaaccctgcatgaatcaatgtacttatgcatcttaagatctgtactctttcagaaatattaccatgtacaggagaaggtgcatcttagatgttcagcagtaattgctcctttttattcatcataagaaggcctactttgggccatcttataatcgtcgttatgagttgaattgtaccctccaaaatatacccttcaatatgctgaagtcctaatccccaatacctgtgaaggtgacctcactggtaatagggactttgcagctgtaataaagttaaaatgaggtcattggagtgagcccttaatccaatatgactaatgtccttgtaagaaaagagaaaatgaaacacagacccagagagaagacagccatgtgaaactgaaggcagagactggagtgatgctgccacaagccaaggaacacctggggctaccagaagctggaataggcaaggaaagatcttcgcctagagccttcagagggagcacaaccctgccaacaccttgatattaggcactgaacctccagaactgagagagaattaattggtactgttttataccgcacactttgtggtataacacttcggtatggcagtcccaggaaactagcgcaatcttacaccaatgctccgaagttgtgctatgttttggtttggctgtgtccccacccaaatctcatcttgaattgtagttccccatatccccacctgtcatgggagggacctagtgagagttaattgaatcatgggggcaggtaccgtcatgctgttcttgggatattgagtaaattctcacaagatctgatggttttataagaggccttttccctttttgctcagcttttcttcttgctgctgccatgtgaagaaggacatgtttgcttccccttctgccatgattataagtttcctgaggcctccccagccctgcagaactgtgagtcaattaaacctcttttctttataaattacccagtctccggtatttcttcatatcagcatgagaatggactaatacaccccgtttttcagatgaggaaactggcagatcactaggggtcaagcatagaaaaggtgcagccagaagaactaatcttttatagtctgtatgagtcagggttctctagagggacagaactaataggatagatatatgtatatatatttaaagatgagtttaagtattaactcacacaatcacagggtcccacaataggctgtctgcaagctgaggagcaaggagaccccattgaagctccaaaactgaagcacttggagaccgatgttcaagggcaggaagcatccagcacaagagaaagatgtaggctgggaggctatgccagtctagtcttttcacgtttttctgcctggtttatattctagccatgctggtagctgattagatggttctcacccagattaagggtgggtctgcctttcctagcccactgactcaaatgttaatctcctttggcaacaccttcacagacacacccaggatcaatactttgcatccttcaattcaatcaagttgacactcagtattaaccatcacagagtcttacccaaaccactcggaggtggcttccagttcattatgggggcataagtgtgtcctcagagacataattcctcttctggctgctttctgggaggaaatgtagaaaaggaaattggaaatattattggcacaagagaggtttgcagttgacaagtaggtaaacccaggctgattcaaaccttgaaaatgattgtgtgagcaacgatagtttttttaaaaatatcaatagttttaggggtatagttggtttttgattacatggataaattctttagaggtgatttctgagattttggtgcatcacctgagcagggtatgttgtacccaatatgtagtctttcatccctcacccctgcccacccttccccctgagtgcccaaagtccattacatcattcttatgcctttgcatcctcttagcttagatctcacttataagtgagaacatacgatgtttggttttccattcatatgttacttcatttagaataacggcctcgagctccatccaagttgctgcaagggccattatttcattctgctttatggctgagtagtatttcatggtgtatatctaccacattttctttattcacttgttggttggcggacatttaggttggatccatatttttgcaactgtgtattgtgctgttataaacatgcgtgtgcatgtgtctttttcatataatgacttcttttcctctgggtagatacccagtagtgggtttgttggatcaaatggtagttatacttttagttctttaaggaatctccatactgttttctgtagttgtactagtttacattcccaccagcagtgtaaaagtgttccctttttaccacattcatgccaacatctatttttttttatttttaaattatggccattcttgcaggagtaaggtggtgtctcattgtggtttaaatttgcatttcctagacaattagtaagaatgttttttaaataatcatgtggagggccaacctgcaagtacaagctgtgacagaggtaatttggaatgtggctccagcattcctcaaaaccatgaacttgggaggccaggagaatgcagtgtggaaccttttctttggcattcagggtgtccagccagaggactctccctcacaaagctttggggtgttgggttgaatgcaaggagggtgggcctggaagatgtcttggaagccttcttcagggtcaacacccacagatccatatattgatcctggccccagttcagtgaccctgacttttgccccagccagggctagaacaagttataccatatctgcacagttccgagatgtgagatgaactacccacaacaacagattttcaggagaggaagaaatgtaccaatcaatgcccatgtagactctaagacaaatattggtacagaaacattaaaaacaataaatggaggcatttaaaacaaatatacatggataggaagattcagtattgtcaagatgtcagtttttcctaacttgatctatatatttaacaaaatcccaattaaaatccagcaatttattgtgttgatgtcaacaaagggaagggctggcaagagccaggcaggaggtcagctccttgccaagggggctggagttcagagtagggggttagccatggctggtggaacagggaggtttcccagggaagtgagaccatgtctgtgaggcctcccacccgcccctcagggggcaggctcaggacatctggaaaccctcaagacctatccacggatgggcacagggaggctcctatctgctccgccctgacatggtcaagattggctctgtcctgtgtgatgtgtgcccacactagaggctgctgtggaggatgctggaccctgtaaatgcctccaggggaggctgtgggggtgtgtggaacatcctagctgctccagccctgcagtccttaggaaacacagggtgagcactctccacacaccttggctctaagaagggacatgcagtatccctgtttccagcagtgtccttccttccattctggagtgccacacaggcatctgtgtctggccattcccaggagtacctggctcataacatggtccagcctcattctgctcccatgtccctctccccacagccagcccagggcagtacagctggatttggcaggtgctcctcctcactcatctcctggggtggctgttcctcagcatggaccccaaagccctctcacaccaagctcctttcgaaatcctaatgtgggtctaagtgtattctgggaactgaggagtgttgcgatgttcaccgcccccaccatctgctacagcctttagtcttctttaactgcctctctgggcatactgaggccctagctgcctctgctaggacaccccagccccacctctctggatcaacctcagaaagcaaaacctcattgtcgcccatttaaggtaatcagttaatcaaaagccaggcattacatgggggattatttgaatagtacctcctaatcatagtaatttgtcactcatcacactgcaatgattattatttaccaaccactaggagactcgccaaaaacttcatcatctcctgccagttctaccacaatatcttggaaggggattccttactggggaatttcaaatgatgatatttgcgtgttaacataatcatcagatcctgtcttgggcccagtggttgttagtagagataagaacggtaaagctgtaaacagggccaactgaggccaagtattggggactatgggcaaatttgggcacagcaacgagagaaggaaacccctggtctcaactgagattttggctattttggccactgccttccacccatactgaggaggacaacaccactttcggaagcctgaaggttgcaggtcacatgaaaaacttcctgtagtcagcatcctatggggtgattcctacccagggccttaaatgcacagaatctggtttctcacatctaaaggagcaaatgtgtatgacaactcctaggtgtagagtgatctgtgttctgtgttgttatggtttgagaattaatgtattgcttctgcagcaccttcaatagaaatgactgtgacaaaataatgtgtctgcttctatttcagtggcaaagagtaatcacatgacccttcctaacttcaaaaggactgtgatgttcccctgtgttcaggaaggaaaggaggacaagacatagatgagcacttgtagtatctcccataaactgttttgcagatgtccaacataaagcaactacaattaatccttgaacaacatgggagttaggggcactgaccctccatgcagtcaaaaatccacctataacttttgcctcccccaaaacttaactaataagctattgtcgactggaagccttattgatgatgtaaacagttgattaacagatatttttgtgtattatgtgtataatatgctgtattctaacaataaactataaaaaaaattaagaaaatcataaggaggagaaaatatatttactattcattaagtggaagtaaatcatcatgaagatatgcgtcattatcatcttcacattgagtaggctgaggaaaaggaagaggaggggttagtcttgctgtctcagggctggcagaggaggaagaggtaggaggggaagcaggagaggcaggcatactcagtgtaattgaatgaaaatacgttgtaattttctttttcttatatctaaaagtttctatatggtaccaatccttcttccactgtttgttttagtttcagtgcccacatcatagaagggtccatgtcgtaaaaggagtcaaaagcagtcttaaaaaattggaactcttctgccagattgtctagtgttagttttttttcctggcaccgtttcttatacatctttttcctcatgatctgtcactggtttggaaacactcatctccatcaagtcaccttctgttatttcctctggcatggtgtctattagctcttgaattttttcaagattcatatcttgaaatcttttacattccatcttttggaccatatccacaacctctttcattgtttccttatttgtctctgtcgtaaatcctgtgaagtcatgcacaacatctggacataattttctccagcagaaatttattgtttaaagtttgatggctttcacagattttctataacaataatggcaccttcaatggtaaaatccttccagactttcataattttctctctatggggtttctcttccatagcgttgacaatcctttccatagagtaccatgtgtagtgagccttagaagtccttatcctgatttagaggctgaattagagaccttgtgtttggggataacttcgatcatttcagcaccctcaatgttgaactcattgggttctgggtggccagggacattgtctaatagcaaaagaactttaaaaggcagtcacttactgccaaggtacctcctgtctccagggacaaagcatcgatagaaccaatccagaataagtgttctaattgtccaggctttcttgttgtacaacccaaagactagaagctgatattttatctttccctttcaaggtttgagggttagcagctttatagataaggacagtcctgatcacaaacttgactgcatttgcataaaacaatagagttagcctattgctttgtgccttaaatcctggtgcttccttctcttcctcactaattaatgtcctttgtggcatttttcccccggagtagggtattttcatctgcattaaaaacctgtacaggcagatatgttttcttctcaataattttcttaatgacgtctgggaacttgtctgctacctcttggttagtagaagctgcttttcctgttatcttgacatttttcaagccaaatctctttctaagattatcaaaccactgcctctatcccagtgggtatatatatatggatatatatatatatatatatatatatatatatatacctgtgctttgcccaaacttgcccatactccccaatatctggcctcagttggcccagtttatatataatgtgtatacatatatatatttcattttattatgtatatatttaaatatatatgtatatacataataaaattattgaaccatcctttgctggcattatattctccagctttatattctacacggatcttttgcgttaagttatcatataataacttggatttttctggattcatattagaatctataggtatgcctttcttgtggcaattctgcaccacataaaggctgcatttgccatatgggataaaaaggtgtttcacaaaatgtgcaaggttttcacacctgctgatgtagttgcagaaacagcttcatgaatttctttttctttttcttttttcttttgtttttacaatggttcttatgcagatttcattaatcttgaaacagtgggcaactacagctgcaaatccaatctacggtacatgttaagcaattcaacttttcttataatgttatttcttttctctgcttcttggcaggaattccagcatcactagtggcacattgtatagatccaatggtgttattcaagttttaaagtattggactaaacatgatggaaaatacgtgagaaccatgagagatcactttttactgctatacgcaatttactggagagacaaactcctcacatggagataattagcgtcccatggcttttcaagcagatagaagaacacttgagcttactgcaatagcaacaggaggtggctatgaaattattacagtagcacagcttatgctacagttaattttatgcagttatgatttaatactacatctcaacatttgtttacatttatcttgactgtgaataataccatgtacggtctgtaactttttgtgtacataaattttgataaaaccttttacaatagacttcatatattttatagtactaaataacaaaatatcctagtatccacatatattttattcattcatgacataactctttttttatatctctaggctatgcagtttgtgagttttttcaaattgttgcaaactccaaaaaaatttccaatatatttatttaaaaagtctgtgtataagtgaacccacatagttcaaacccatgttgttcaaaggtcaactgtattataatttattactacagcaatcctcttcatttctgggaggaatttctgaaaaggtcagatttgcttcaaaattccccagctttttcaagtacctacttattatatgacagatgcttcaaatacaggatcacatctacttttcaaataattctagaaatctcatcagggaaggttcaccttcttcactcaatggcacatttctgcacttccctttgcaataacctctaatctcagtaggttgagatttttaccctatttgattcatggtcaaaattttaacttgtgagtctttgttactgtccacataactgaacttacctgaagacttgtgcaagtgccattaggcactttgcaaacaaggattttcctgtggagaggcacacagacaagagatagcagaaatatagtttttttttttctttttaaatcagagctagcatgtccaaagaggaagcgtttttcacctccttggagggctccagggtttttagaaattctgcttcagtagatttttttttcctacagtggtttacatggtctttctgcatctacaagctttgatgtttgaccacctaggtaagcttattaacctgtgtgtattcagtggaaagtctaataagacattttattaaaatcctactcctatatctagatgctttcaaaaaccctttatctaactttacatttcagtaacaagaaggaatacgttgtgtgccaaatcagagcctgcacccatttggaaaagtttcagagtgtattttgactctcaggcatataaccaggcatctgaacatcactgtccaagtgaacttttatgtcaaagaggctgttgccattagaggagttccagggtgagcaatgtgacagccaaaggacgttttcaggaagcaggcatgctctatgtcagggggaaggcaggtgattctgggccattccactgggagcaaggcacagttttcagatgatcattttcacatgcttactttaggtcagcttttagtgccttgacctcagcattcttctttttgtcaccttagagacattctgcaatacttactacaaaaatgaattacaagtcagaagatagacctcaagctggggagaatgggaatagcgtggtctctagatgaatcaggccagggatctggtgccaatctgtcacttactaactatgtgatcctgggaaattactaagcccagtgagcctcagtttctttatctgtaacatgtgtttggtactttttataatagactattagaatataagacatttattaaaacacttggcacagtgcctgacatacattgcatctttaataactatcatttatttcttttttttttttgagacagagtttcactcttgttgcccaggctggagtgcaatggcatgatctcggctcaccgcaacctccgcctcccaggttcaagcaattctcctgcctcagcctcccgagtagctgggattacaggcatgcaccaccacgcctggctaattttgtatttttagtagagacagggtttctccatgttgaggctggtctcgaactcctgacctcaggtgatccacccacctcagcctcccaaagtgctgggattacaggtgtgagccaccgtgcccagcccaactatcatttatttctaacattattttgaccccagattttggaaaatatttttgttttccaggacatctcagagaatttgcagttgaatgggaaacagaattatcactaaaaaatgctgcttagtaaatgtcccttgaagaggattcattatttaattaggtgttggggagtcttccatagctgagtgcaactcactaactttaagatcctagaatttgggtcacaaactcctttcttccctcccagcttctgtttcaaccaaaccactatttttcattcacctcattcatatcatccccaccaaaagtatagccatttcagtggagtcagctgtacaccaaaccaggcagaagagtacctggccagtggcttctggcctcccttcctgagagattcatgcttatctcaggaaattcttgcagatggcagatgttgggtatcagtcagccacctcttacactgtgttcgactacactgggacaaaagtgcaggacaccttccattcctgcccctggtggagactcctctctgctacatccaccacccaaaaggaacttctcagagcagtttttcattccaggcttttctctaaccctctaagactcatggtctgagattgtggcgcttgtcagcttcattataatcaactcctcaagaaggaactgcggtttcccaaagatcaaaacgcccagctcagggcatttaacttcaccactctcacctggagccccacaccctcacccctctcttacttttcctctgcatcttagaggacatctcgccaccttaattacatgaatgcaactcctagactctactactctaagggtaggggtttctctggcttattctagtaactccactactaacccagagccttccaaagaggagatgctcataaaagttgtggaaagaaagactcagtgagcaggtcttttgtttaagttgtaatttctcctacaaccttcaaaaagcgaagcaaatccagttatatgtatatgtttcaatttttatagaacaacagatgaaaatggataaaaaggctagaattagcagacttttccttttattttatggccccatcaatcttattgataatttcttacatttgccaagaaaatatctattccaatgccatggtatattgttataagtcacaaagcaatatggaaggtttcccagtatgtctcactgaaggcagcagtggccagtctggagtggatgctaccatcatatgaactacaacagggaggtgcagccagggctgcacactccttggaaccagcatgaggcagggacaagtgggagccctgccccttccgagttggtggggtgggagctccccgggtgcagccacagccacccaagtcgcagctttggatacaggcctcccgcttcatggagcagacaggagcctcactcccctgggtgcagctgcagctacccaagtcgcagctttggatacaggcctcccgcttcatggagcagacaggagcctcactcccctgggtgcagctgcagccacccaaaccatcgctgcagacccaggcatcctgctgcatggagcaggcagaagccccgcccccctcccctgggcacagctgcaaccgcccaaaccatcactgcagattctggcatacctgccctcttgggggcccaggaaggcccccaccaccctggcagggtcagaaatgcctgctcctactcctggcttctccctgctatcagcaaccactccagactcagagcaaagttgggccaagcccaggtgctgccacagcctggctgggtgtgcacacactcagggcagtgctgacatgtcagtcccctgctggcttggacccctacggaatttgggcgccaatgagcatagtagggaagctgatggggtggtgagggcagctcataactggcctgtaggcatcccttggcacctatggcctgggctctgtgaatgacagcaggaggcagacaggttcctggtcagaaggcggcgagtccctggtgaggccccaccttcaggccggggagggcctgaagtctgggggctgggctgccagtcctgtggaccagagtgggaacttgtggtgccttttctgggcccacccatggccaccgatggaccaattggcatgcactttctcccttctgaggcccaaaaatccccaggctcagccagaagtgagcagatgtcgggacaaccagcttcagagaggagctatccactccagggcctcccctctgctggaagctgcagagatgggaggacctgcctgcagagagaagcttcccactccagggtctcctctctgctaggagctgaacacttgttgggacaccctgcctgcaggaaggagctgaccccctgcaggagactaagctgttctattgctaattaaagctcctcttcatcttgctcaccctccatttgtctgtgtacctcattcttcctggtcacaggacaagaacttggaacccattgaatagctgagctaatagagctgtaacacaaacagactgaaatatgccccttgctcaccatgttgcgagcaaagagaaggagataagacctgtggcccatccgggagcccagacctgggagctccctgagccagggctgtgactccctctttggggccttgcagttcctggcatctccaagcttctaggtgccaccatgttctgcagtgccagctgtggaagctgcttgtggtgtgcctggtccagctgcaggtttgtggagagccaacacctgtgccagtgcctagagctgcctgccccactgcagcagctggcatgtcggactgtgtgcagtggctggaccccacagtcattcacacaaccctcaccattccacgcctgactcgcccttggcgggaattggacacagactggtagtgcgagctgagtgcagcatgccagattgaatggtcaaaacaagcccaacaggcccaagcaaaattcaggcaaaggtgccagtggccacagaggtttcttgccagaaaaatgacaccccaaaggtcccataacattacaaaataacaaactcttatacatgaaatggattagtaaaaatacatgtgtgattaatatcattcataaacttagatgttaaaactaattaaatcttctgttaaaaggaacaaatttgaaaattactaaaaggaaacaaagataaatctccaatcactcaatagaacaggaagccaaagatggtatgcaatgtgtttccttccacccaccttgacctcccttaccaagaactctgactactctgttcaaatacagggtgaagaaagggcctgatttcacatggggtaggttgtgcccctggaacttgcactggccctgtccctaaacctgccacctggtggccctggctgcaacttgtactcatactccctcttccccctctcttaaagcctcttcttacagagacgggtaggaggtgggatctgtcccatggaccttggccacatactccaggactttcatcttgttggttttagtgtgggctcttggactctacaggaactcatagtgtgcaggatcactgctgggcacctggtggtactccaggtagttttcctgcacccagtcttgggtgagcagcttcctgggcttcccatagacactgtgcttcttcccagcatacagccccatcacactcagggtttcccatatgacctcttcaggggtgcagttgccctccattataatcgtgcacaggaccattatctggaggcctgcattgggcttgctctgatcatcacccagcaggccgtcataggagaggcccagggaagtgacaaggatgtaggagtggccagtggtatccacttccttcatgtcaaaaaaaaaaaagaccagccacatgcacttgaagatcacaggaaagtaatccttataatttttgatgacactctctagcatttctgcctttgtgtttgtctccttgactcaatacttgtagagcaggaaatgaaccaactcagtcaccttcccatcaagtgcttcttggaacaaggtcttcaggtctgctgggtctggtgaggtgcctggagcctcctcttggctgctggagccctcattagattggctccatagagtgttgtcaatggtagtgggggaggtagaggttccctgaggactctggggagaaccaggtgacccagcagcaggcagcccctccagggtgcccactgtcagaggagaggagaaggaggcagcctcctgttcctcagccaagggagcctgcacacccaccaggcccaaagcctcgtctccttcggcctcaaggctttcctcaggctcgcagtgctgattcctctgctcaggagacatgatgactctggtcagaatggcagagtgtgggcaggagctgggcaagtgggacccacaggcctgaggagagagggagccagtgagggacctcagctgagagccgaaccttggaggctctaacaaaagcagacttatggatcttttcatttggtgctcctctggggcctcctggggcacctatcctcctagctggcctgttcaccgagaacttggaggaagtgagagtgttacagtgggtagctagtcaggtatgaatagggaaggagagggttcccccagccccttcactcatgtgcacatgcatgcgtgcgtgcacacacacacactaggaatgttgggtgaccattaggcgatggtcaagtggttgttaactatttctgtaaagtaataattgttcacagcccttgccaggggaaggcagtctcctaatagaaaacacctgaaatggatcagcagcttcccaacaagatctcaggactggggagaaagtaacacaagatctctgaagtaggctgatatggtttggctgtgtccccacccaaatctcatcttgaattcccacgcattgtgggagggacccagtgggaggtaactgaatcatagaggcaggtccttcccatgctgttctcatgatagtaagtctcatgagatctgatggttattataaaggggagttttcctgcaaaagcttttttttttttttttttgcttgctgccatccatgtaagatgtgactttctcctccttgccttctgccatgattgtgaggcttccccagccacacggaactgtaagtccagttaaacgtctttctattgtaaattgcccggtcttgggtatgtctttatcagcaatgtgaaaactaatacatatgccaacataaaaccccaagtcaagaggtcaagctgtgactttggtttctcaagttgactacttggccctcttccgagttatacttttcttgtttcctttccttcctttccttactgttctaaagctttgtgttttgtttgtttgtttgtttgttttttgcctcagtctttccttctgcctttggcccctcagtcgaattctttcttctgaggaggtaagaactgaaattgccgcagacctatatggatacaccaccagtaactcagggtaacttgggtacctgccaccactaacaagagggctcctcagggtgcagcttgtcagcagaagccacggctccagcaataacagtaggacaggtgggttggcactttggagtcccctctgctctggggccggtggagccctttgtatacatttaaagtaaacacctcaccttgcctgctggcaatacctgggcctcctctgctgtatgacttcaggacactgcctcagaccaaggcccaaacctctctgagacctgggagaaagaagtgagggggcaccacacggaaaattctgcacgggattcccaaggctgacagaaggagcaggtttcaggggtgcctcctctgtctgcgttcctccaggtattcagatttattcccgacagggcccagccctttcgctcctgctcaactgtggatgagtcttgtgtgccaaggccaccatcttcctgggacccccaaggagaaagtgggggaccatgtcccttctccacaggcctgccttgggcctcccaggactgatagcagaggcagatttcctaggtccaggataacaggtctgctgagtcctctctcagggctctaggggacttctctctttgctggcctgaggccctactcctcatattacacccctctcgtcactggcaccccaaagacacagcaaagatgtgccacacacagccagcactcccaggacctcccagggtcgaggtcctctgagtcctccctcttcttcctcctcttgatcctgtcagggctgagcctcacccctttgtggacctgaatctatatccctcaaattcccaaggccaattgagaaggtgcctcagtctcagaaagaagtggagtaggccccctgttctgggttgctgggtcccctcaggcctgccttgtctcccagcctggcctggacccaccttctgctcccctgaggccgtgctcatgattccaagccccttccctccatcagcccccgatgtgaacatcaggatccacatgcctgtccaccatgcccggaacttcccagggctgacagcagagatggagcctcgctctgtgggatctcagccctccttcagggtctggaccatgatgcctggcaggcagagcatgggtcctgccctttcctaatcagcctttccctggtcacaccaagctctgtctccagaatgccctgcggcttaagtggcagtggagccgggagcggcccagcctgagaagtctgcccccaggtggcccagggctggcagcaggggtggcactgggttaattggggtcctctctctggggtaggggcatcctcagtcttcctcagtgtctcaccttgcctcctcacagagccggggcctgtttcactccaccaatctcaagctgccactcagagcgaggcgctcttgctatcctctgacccctgaggccacgtcagtggcgtgacatccggcccccaagcctggggcttccctgggtcgacagcagcagcggaactggattcttccaggcatgggggtaggaatggttataggggccctcaagcttcccttagggtcctgacattgattccttgcagagcctggacaccctgccctctgccaattgggtctgctcccttcacaccaagtctctgactcccagtcccctgaggtggcagtggtgggaggcgtgtgttcagggcgacaacattgccaggatcttccaggattgttagaaggggctgagctggattctctggttcctctacaaggggagggtggactctcagtcctcactcaagaggatcctcctcctggctcttggatctttgatgaagccatgggcaggagatactctgtttctgccacttctgagcatttgcccagctgcatctcttgcagagaatggctgcgggtcccaggccaggtactccctgcagagcggcagcttctgtgattgtagtgacctctgggagaagacacacaccttcccaaggaagctcttccccagccacaggtcgagtttgcaaacctgttttcctaaaatatttgtttttacattaaataggctgagcagcagcatgaaatttggggattcctgccattagaattatcgagtatttcatagctcagtgcagtgattttcatttttaaactttcattcagcatcagaaatcatacttaacctcattatgcctgtttcattctaatgctcaacactctatttgtaatccattctttatgttcagttaagccaattcacctattaatgtggttttaggtggttattagcacagactggagctactactgtttcaatgaaaccagactactggcacctgtggtctcaggtgccacctgacattttcacactggaataggggcaaaaatttaaacatttccttctacacatcctgtcatcttccttctatgccagctatggactctccctaacttccttgacactctggccatttcgattacaggtaccagttaaacacagtcttcattctcccccagggctttgctttgttgtttagattttgttgttgatactatttgtttttttattttattttattctttcttctatagttttccaggattgattttggtagttgagggcagaagtccaagcctgacattcatcttggcagctaaattttaagcattatatctgtaaatcttgaataagaaaaattgatatcttttcaatagtctgttccctattaagggatatagaatacggctctgtttatctgggaactttttgacctaactctatcagtacttgcatagttgtttccataaagatcttgtatgctttgtctgtctccattggataatttctagattttgttgccattgtgaatggggtattttctattacttgttctgaatagttatttatttgggttgcaaggattttgattttactgtagtaatcttctgtatactatttttctgaagtctgttatttgactattccatctgcacaattctttgaattttctagataatcatattgtcgtaccaaatattaaatctgttcaatatttatactgattttttttttatatccacctctctggccttatgttacagtgtaatttccaaagatagaggttatagcatagtcct

SEQ ID NO: 630 - DNA, 87377 bp, Homo sapiens
aaatgcattagcccatccaatttgaagagcatcctgtaaaggtcagcagaaagagttcaccttcttcactccatagcatttactgcacttccttttgcagtgccatctgtcatctcaggaggccgaagatttcctccttccatctgatgcaggggcagaattttgctcagagtctttgataccttccacataaccattcttgcctgaacacctgtacaggcaccactagtcacactgaaagccagtatgttcctggggagagatgccagacaggaggcagtggaaggctgattaattattcttttcaaattctagctggcatgtcaatcatggaaccatttttcacctcctgggagaagcccagggtttgtaggaattcagactcagttgatcgctgttcctcttagaattcttatgaggggatggaagttttgagcacctaagaaagcctgtccctgtgtttgcccgttcagtccccaggttcagataagaaggtcattaaaataaaactgcaaatatgctagtgactggacaaactctctgtctaccttcaggcctgtaccctaagaaccaggaaattatgtttcaaatcatactctacttgcagcccactgggaaaacaaacagtatgcagaggatttcccagagggaataccaagcgtctaaagttgcagtccagggtggctgtggctgtgagacaagaccaagggtgtgtggtggcagagtcaagggacttttgcaggggataggattactccatgtcccagggaggggaggtgattctgcacagcctccaggggaggcagcagtgaagaccggacagcaggccagttcccctagtcagaagggagggcacatgagggtgactgagaaagggtgctgtgacacgagaaactgtcggggccagaaacaaatcctgggagtgtacttgtcccatgtgcccaggaaggacaggaatgcaagatgtggatgagcacttgaagcctctcccacaacctgatgagcacccatagtaggtgctcaacagaaagcattcagccatgagctcccaggggacttagcacatgccaccccctaatggtgtttgattctcattgtcacctttgtagacctgcttttagtaccttggtctcagggttctttctgtcacctgagagacatggcgcagtgctgagaagatgcagtcaggagatggggctcaggctggggggagggggaacagcataggctctggaggaattcagaccaggggtctttccagccctgtcccttagtagccacgggattctgggaaatacccaagccctgtgaacctcaagctctacgtctgtgaagcaggtgtgacaagtcctttccactaggactgttggagtgtgtgccatgcaagtgaagcacctagctcagggcctggcgtaaattacaagtttaaagaacggcgaatggctgttttttcctatattattttaccccaggccttaacactctgggattttgttgttgttgtcattgttctccaggacttatcagataatatacagcttggtaagacatggaataatcagtcaaagaatgaagtttcatctataaaattcagtaaatatttcctcttagaggacatacttcaaactttggttgttggggagttttcccaagccagatgcagctcacagctcctagaatttgagtcaaggaccaactccttccttctctgcccgctgcttttccatccaaaccactacttttttttcatttcattgccacccaaaatctagccgttgctaaaattagccaaatggcacttgagatgacctaattagaatgtcattttaatagagtcagctttggctcccagccaggcagaagagtacctgtccagtggcttctgggcctcacttccagggatattcacccttatctctcagaaaacacttgcaggtgatgcgtatccatcacctagctcttgtgctgtgttccacctcactggaacaggagcacagaatgctttccattcctgccccagatggaaactcctctctgctttatccactattcaaaaggaactgctgagcagttttctattccaggcttttctctcatgcctgagaatctggctctggcaccacacagcttcattacaattagctccccgagaaggaactacagtttcccaaagtccaaaaggttttggctcagggcatgtacactcaactattaatactctcacctgttgctccacaccctcaccgctctcttattttccctccagatcttagaagacatctagccactttaattatgtgactgcagatcctagactctaccgccctaaggttaggggtggatgtggcttaccttagcatctctactattaacctaagccttccaaatagcagatgctcaatgaatcttttgagaaaaaatgagccagtgagcagggggacctaattattcatatgtaattctcttgcatgatcaaataagccaagcaaatctggtaagacttcaggatagtgggttccctcctggcccaggacaggtctaaaaatgccgtccaaaagccaagttctgaaatcaagaaccccaaaagacagcttggttgtcttctccactgtgggttctaagggccctcactgaaaccagttatgtgaaaccacctggtagttttcctgaaccaaatcttgtggaaaataaacttattaggctgtccgccaggcacaagaattaccctgtgaaaggcatactggaaaacctaccatcagctcccctccatctccagttaggtcagcctcaccagatattctggtactagaacttcagtttggctgggggctctgaaaacagccccttaggcaggcttcccatgagctaaaccaactgaaactgagcagaccaaagaatgagccagatgaggaatctacccattctaaccaaccagcctgtttgtcttactcatccacgtacaaaagaaagtgttagcagctgcacagagtccttcctgttgagctagaaggttgcagttccatgatctagtatcccatcacgggctaaactgaggcagggagtgaggccaagtggatcttgaagtctgactataaaagggatccctagcaaagtttaaacaaacaattgcatcaaggatgtttctaaatttagccactgggtggattaaagaatgtcttgggtcatgtaaagatatgggcttggcatgggatatccaatgttctatggaagctgatcattgtaaaattctaactacatgtcaccctggacccacacaggtctgaactgcatgggtccacttatgcatggattttcttctgcctctgccatccctgagacagcaagaacaagccctccttttcttcctcctcctcagcctattcaatgtgaagttgatgagaatgaagatttttatcattatccacttctacttagtgaacagtaaatatgttttctcctctgtatgactttcttaataaccctttcttacctctagctttctttattgtacaaatatagtacataatacacttaaaacacaaaatatgtgttcatccataatatttccagtcaacagcaggctaatagtagttatgtttctgggggttcaatgtttatacacagatttttgactgcattgggagtcggtccccttaacccccacctcgttcaaaggtctagcatacaggtgttatcttgccaagtgaaagagggaagcataagcaagaaaaaattaagagggataaggatgtcattgtgaaagggagtcttgtttcaacatcttcagagaagctgtctacaggatgaagtcatcgagttctcattctggcttatagcttgaaagtctgcttatggcttcaggcattgtggtgaactctctgagtggctcacacatcaggcgggagggttgtttgttgacgtttacatgagatgttgagctgcagcttacagaggacctgagcagttcccgttagtatgagacttgcagccagataatggagaaaattagaacaatttagaatcatgtatggcctgcaattagactcgaaaacaacgaacagagctacaagctaataacaagtataccatagtttttttaattttcctgaaacttaatttttctctcttctgtctgcatttctatcaaagataactagagtaagactattttgataaaaaaataagtttagtctcatcaaacttagaatgattacttatgtaagtgcagcaaggatccattagccacataggctcttttaaagtttgctttgttggaacttttagggaggattctcagatttcagttttcaaagcctctttatgctaggaagccaaaccaaggtggacttcagactttgtctgctgcacctatagatttgggtgaatttctctcttctcggggtcccccaaatattttgaggttcctgggctttccaggaagtgactttttttctcactataaatctgggaacacttaaagccatacattctatggacgttctcaaacatggtatcgcagtgacaacctgggtagtataactagtattcccagttgcatcctgttataaagagagcagactgtgattgaacttatgcaaacaactttgccataaaatccagaacacccacaaattgtctctgggaggcaagttttacaaaaaccttttttagaaatttgtgcacatgaataggcatccatgtgggggcctatttcagagggcctaatttttaagcacatttttgggatgaacagtattgttcatctgaaatgtttcacatgatggccattgtaagtctaaattatccttatgaagattgcacctttttgaaaaggtttgctgattctgctgcgtaatacttacgcatatagaaagcaggcatagccagaaggtggagtacacagttgtctggaaagcaaggatcccatttttatgttgattcagagataagatcaaagtctaagaaggaaatgccacgggattgggtcctggtttgctttccagtgaaccttgctgcatggatgctgtcttgaggctgacggtgacatggtatttaacttatttgtttcatgaccagctgatcctaacacagacgtcttatttttaggtggcgagtgctctaatcgctcctaagtgcctaaactggagccaccagtcagtcatggctatggctctgagcttcccctgactaacgtagccagtgaatctctcctaccgaagcatacaagcaaaagaaactggagaacccacatccctgcaaatttccaaaagccagagtcacacactgcatgtgataatctgctcctgccatcagttacctttaaaactacatgtattgtcagtgacttgttagctcccacaaacccccaggtcatgttctctctcacaggacaaatgaatcctggaatcaagagccaaaagagtcaggggactcaatgcaaaaatctgacccgagaggaaattagaacacttgtgtctctgtgagggtgagaggggcctccaaagctgtcagtggcatcttccctgcatttgtcaaggagtctccagagacatcagctgtgtcttttgtgtcccttcatgggttgccagaaactgccaagagaataaatgacatcaaatacgatttgaagatcgagctggcttttaaagttttttcacaatactagaattggacaacacaacattctataaaataaaatgagtgttccagtgaaccgagcagaggaggttggcttcataggcagaacagtgctaaagaaagcagaaataagaaaaaaaaatagaaagaaagaaagcagattggtcatttcaaatttactttccacttagggttaaagaagaggagacttccttactatgctgactcaggttaattggaagattctgcacttttttttttttaattggccccttggaaagccctggatgcttacgtggcactcagcacaagtgaccatgttctggttgggtgtggtcagctggggcttaggacaggaggctagttcacagaaatggcctcccctcccctgaaggttgtttcacacaagcccctgaattaatgagtctttctaaaggaggctgtgctagctttcctaaacagaacagtttcccccttttcagttgttcttgaagagtttccatattttgacttacagtacttacctattcttggatattatccactttttccattagggcccacagcgtgttactcatacttgtcttaaattcccagtcagatcattccaacatctctatcatatctgagtctgtttctgatacctgctctttgtcttcacactgtgtgtgtgtgttttttttttttttttttttgtctattagtatgctttgaaatttccttttgcaaacttgccacgatgtgtcagatgaaaagaatggagttaaataggcctttagtgtgaggtttaccttcatctggctgtgtttactgtttgctgtagctgtaggtgtcagaggctaaacctccctgtggtgtccttcacttttcctccttggctgtgtttggttttccttggagacctgctcactatggtctggcactcacagttctttcagtttcattccccagttgatgtggcagtgagctgcagagggaggggaagacttctatcctcctatgactacatggcaggcttgagtcagtgtacaccgggctgtggctttcactagtgcttctcagttttgttttgttttctccttggacagacattaaggggccagaatgttgtagctgggtgttttccttacccagtgttgatgagagtctagaaaaaaaccaagtaggacagactctggtaaaacagtttctcttgagggcagaccctcgtttgaagaacagaatactctgggcatattttcgaatgactcctttctccctctggtcctcactgggggaacctgatagggctcccagaggtgaaactctggaaactgtggtagccttctggatggtgcccccaggagtttttagttctcaaatttgtccatagtgagccctccaccattcgtcttataaagatgaggttttcgtatcctggtccttgtttctgggcattcagctcctgagcttctgctctccaaagttgtggctgactgtatctactgtctcttccgttttgggtcagcaatcagccctatggcctcagctctctgagggatcagagaaaagttgttgttttccaatttgttcagcttcttatcttgtttgcgtcagaggcagagagccatctagctccttacatacccgagtgaacataagcatttaagaaaattggaaaacttttttaaacatagcagttttacataggtatacatgtggcatggtggtttgctgcacccatcaacctgtcatctacattaggtatttctcctaatgctatccctcctctagccccccaccccctgacaggccccagtgtatgatgctcccctccctgtgtccatgtgttctcatggtttaactcccacttatgagtgagaacatgcggtgttcggatttctgttcttgtgttagtttgctgagaatgatggtttccagcttcatccatgtccctacaaaggacgtgaactcatccttttttatggctgcatagtattccatggtgtatatgtgccacattttctttatccagtctatcattgttggacatttgggttggtaccaagtctttgctattgtgaatagtgccgcatggcacgtggatacctatgtaacaaacctgcacgttctgtactatgtaacaaacctgcaggttctgcacatataccccagaacttaaaatgtaataatagtaatttaaaattaaaagagattccctggaaaaaaaatcccatctcaatcactttgctcttttagtatcacttcttgtgtgccctttcctcctttccaaataatcatttgaggcccagctgatacagcatattatcctcaaaggctttgttgactccagctacactgtagattctgtactatacattcttgattttttttaccaaaaaaaaacccaaaaaacaaaaacaaaaacaaaatagccattttaataaaattaaaaatgaaatgctttggtatatatctaacaaaacatgtacatatcaggatggtgaaaactacaaaatgctgatgaaaaattcaaagaaggcccaactaaatagacatagcatgtacattcactggaagactcagtgaagatatgtgatctgtaacaaagcgatccatagatccaatgtaactccagtaaaataccagcaagcttttttgtacttgtacacaagctgattcaaaaagcatacggaaaggtaaaggttttgaaataattaaaacaattttcaaaacacagagtaattgcacaaatcgtaccactcaattttaagatttagcataagcctaaaacaatcaagtcattatggacttttctaagggatacacgtatagattaatggattaaaacagagaatccataaatagatccacgcgaatatagcaatggaggttttagaaaggggtaaagacaatttattggaaaaatattagtcttttcaattagtggtattggaacaactgaacatccatgtgttataaaaaagacttgaccaaaacctcacatgttatacaaaaattaactcaaagtggattacagatccaaatgttacatgaaatactataaaacttttaaagaaggccgggtgcagtggctcacgcctgtaatcccagcactttgggaggccgaggtgggcagatcacgaggtcaggagttcaagaccagcctggccaacatggtgaaaccccatctctagtaaaaatataaaaattagctgggcgtggtggtgcgcacctgcaatcccagctactcgggaggctgaagcaggagaatcgcttgaacccgggaggcggaggttgcagtgagccgagatcctgccattgcactccagcctgggcaatagagtgagactccgtctcaaaaaacaaacaaacaaacaaacaaacaaacaacaacagcaagaaaaaacttaaagaaaacacagggtgaaatattagtagcctgatgtgaggcaaagaggtcttaaacatgacaccagcagtgtgattcataaagaaaagaaacaataaattagacttcctcagagttaaaacttttgctctgagaaagacactgaagagacactaaaaagccaaacgaagtattcacaagtatttgcaaatcatatatacaccaaaggccttttatgaaaattgtataaagattcccaaaatctcaaaacttagaacacatgtcaaaacacaaagtttcaccaaattttgttcaaagatctaactggcttttctttatgattcttgaatgggcattttttctctccgtcaacttgaatgagtgtccctatgtgctgagcaaaagacgttggcttataggcagaagaggacgaaaaaagtagaaacagggaacaaaaggtggtttggtgatttcaaagttgatttccttgtaggattaaagcagagaaaactttcttatcgtgcctgctcaggtacggtgggctccttgttattggttgctgtgactattctgtttttagttttttgagaactggcccgtttcaatgttcactttgatgaatggcaattagtacaagggacactattctgattttgtctgttctgctggggtctggggccagagattagggcaaaacaatggcctcccatgagttcatttaacacaaacaaccacattttttagaagggcaaaacatatcaatagacatttcacccaaaaggacatacgcatgacaaataagcccatgaaaaactattctacatcacagctattagagaaatgcaaattaaaccatgatcagatgccataacacatatttgaaaatgactgaaatttttaacgagatacttgtaagtgctaacaaggatgaagaacaacttgaaatttcatacattgctagtggcagttatgaaacgggacaactgcagaaaatgatttggtaattacttatgaacacatgccatgtgactcagcgatttcatctaagggaaaaagaaaaatttatgttcacacaaaagcctatgtacgtgaatgtttatagcagctccagtcatatttgccaaaacctggaaattatacaaatgtatttccatgggtaaatgggaaatgaaattttggggcatccttacttactatgaaatacttctcagcaatgaaaaagaatgaactactgatacacacaacaatgtgtttcaaactcgaaggtgttttgctgtgtgaaaggagccagtctcaaccagttacatattctattattctgtttacctggcattcttgaaagagaaaactgaaacgatggagtacagatgagtggctgtcagggttcggcgcgcagtggtgggtacagctataaatgaattgcacatggagggggtttcttttggggagaagacgtaataatcttaactattaattcacctaaaagcagagcttcaaaatgcaagaaactacatctgatagaactgcaaggataaatcgccaaatctacaatgatatttggagatggcaacagtcctctccaagtaaatgattgaagtagacagaaattctgcaagggtgtaggaggagctgaacaacaaagaacaaatgtgagctgattagattttagtgagcactcctcagaacgacggtagattatatggtattttcaagtgtgtgtggaatttttaccaaaagagaccagaaaacaacccataaaaaatttaaaataattggaattgtacaaagtatctttttaaaatctataatggaatgtaattcaaaatataacaaaggaaatatctgtaaagtccttaagtatttttaaaataaacaacacatttttactaatccatgtttaaaaaaattcttgaggaaggttagaaaatattttcaaataaataaaaatggaaatgtgatgttttaaaatatctgcaatttagctaaaatgtgcctaggggacattttatgtactgaaatgtttatattagaaagtaataaaagactcaaatatgtatattttgatctcaaatagctagaaaaggaaaaggaaattaaacctaaggtgagcaaaacgatggggataatatagacaagaagagaaaaattaatgaaattgagatttcagaagttttagaaaaacaataaataatactgatggaatcaaaagttagatctttaagtagatcagacaagccgaaaggcccgaagtcaatctgagaaatttaaaacacatgggtttgggccaggtgcagtggttcaagcctgtaatcccagtacttcttgaggcagaagcaggcagatccgttgaggccaggagttcaagaccagcctggccaagatggtgaaaccctgtctctactaaaaatacaaaaattagccaggcgtgcggtgcatgcctctaataccagctattcgggagactgaggtacgaaaatggcttgagcctgggaggcagggattgcagtgagctgtgatcttgccactgcactccagcttgggcaacagagtgagtctctgtctcacaaaacaaagccaaaccccagaaaacgtggttttggagaagcaacagcgttgaacacagctagaagtagaggacactttacagaaactattaactgttgtgacaacaacaatgtttcttagagaagtttctgagaagaccagatttgccttgaaatgctcgacgtgtctgctatgttacagatgctttcaaacgtattaacccaggggtccccaacacccccggccatggataggaactgggctgcacagcaggaagtgagtggttgggcaagcaggtgaagctgaactccacctcctgtcacgtcagtggcgacattagattctcataggagcgggaaccctattgtgaactgcacacgtgaggggtctaggttttgtgttcctgatgagaatctaacgcttgatgatctgttactgtctcccatcacccccagatgggaccatctatttgcaggaaaacaagctcagggctcccactgattctgcacgacggtgagtatgcaataataatagaaataaagtgcgcaataaatgtaatgtgcttgaatcatcttgaaacaatgccccacccccaccccgtgctcatggaaaaattgtcttccagaaaccggtccctggtgccaggaagggtggggatcactgcattaacccatctgatttgaagaggatcctgtaaggtcagcatggagagttcaccttgtacactccatagcattttctgcacttccctttgccacaccatctatcagctcaggaagctgaggatttcctccttccatctgatgcaggggcagaatcttacccatcatctctgctaccctccatatgactgttcttacctgaacacctgtataggtgccactagtcacgctgaaagccggcatgttcctggggacagatgccagacaggaagcagtgaaaggctggttaaatattcttttgaaactccagctggcatgttcgccatggaaccatttttcccctcctgggaggagcccagggtttgtaagaattcagcttcatgaaatggctgctcctcttctacctcttaggaggggaatttctgagcaccatccgtctgtttgcgtgttctgtccccagcttcagataacaaactcaataaaatcctactacaaatatgcaactgactgcgaaaatactctctcaatcctgggggctgcaacccaaccaggagcttatgggtcaaattggactcttctcacagcccactgggaatacacagagtagaattctcccagggagggaggaccaagtgtctaaagtcaccgtccagaatggttgcggctgtgggactggactaagggcgagccgtgcgagaaccaggggactacttcaagggctaggaatgctccatgttgcaggaagggcaggggggtctgcccagcctccagggggaggcaacagtgaagagcaagcagcaggtcaggtcgcagagtcagaagggaggaaacatgatagtgaccggggaagggcactgtgacacgggaacgtgctgatgccagacagaagtgctgattatgtattcgtcccttgtgcccaggaaagagaagatcaaagatgtggatgagcatttgtaggcgctcctacaacctgttgcatagtaggtgctcaacaggcagcacccagcagacagttcccaggggacccccggcatgccatccccaaattgtatttgatgctcattggcaccttctttaggcctgcatttagtaccttggcctcagggtccttctttttgttgcctgagagacatgatgcattgctgagaagaggaatgaagtgccagtgaggaggtctgcctccggctcaggggagtgggaacagcacgggctctagaggaattcagatcagggatccggttccagctctgttccttactagccacctgatcctgggaaatacccaagttctgtgagcctctggttcttcatctgtgaagcaggtatgatgaggcccttccactaggacggttagagtgcgtgcaatgtaagtgaagcatctggctcagggcctggcattaagttagaagtttaaggaatggcggatggctgtcatatctaatactatttgaccctagaccctagcactctgggatttcgtaaatgttgttgttctccaagacttaccagagaatatacagctcagtaggacatgggataatcagccccaacaggaagtttcgtcaataaaattaagtatttcctcttagcgaaggtgcttcaaaatttgggtgtgctggagtcttgcgcagctgaatgcagctcaaagctcctagaatttgaatcgaggatcaactcctttcctctctcccacctgcttttggatccgagactctgttttcacttattttgttaacactcgaaatctagcctttgctcacaattggtcaaatcccacctgagataacttgattagaatgccttttaaatacgatcaactctggctctcccagacaggcagaaaagcacctggccaatgacttctgggcttcccttctgggagattcaccctcatcttgcaggaaacccttgcagatgataggtatccatcacctagcccctgcactgtgttcaagcgcaccgagacaagagcgcgggacgatttccttctattcctgccccaggtggagactcttctctgttcatccactatccaaaaggaactgctgagcagtcgtccattccaggcctttctctcatcctctgagaatctggctctggcaccacccagcttcaatagaattacctcccccagaaggaactgcagtttcccaaagcccaaagggccctggctcagggcatatacactcgactgctgtcatctagagccccaaaccctcacccatgttttattttcctctacttcttagaggacatggcaccaccttaattttaggattgtagcccctagacttcaccaccctatggcaaaggggtgggtctggcttaccgagcatctctactactaacccagggtgttccgaataacagatgttcagtgcgtgtctgaagaaaaaatgagccagtgaacaggaaaaattattctttcaatttttatttctcttacatgctcaaagaagccaagcaaatccaggtatacatgtatatattttaattttacaggagagagaaagaggtataaggcaagaattaactacattttcatttcactatttctttatgagctctattttgctgctaagttcaagtttcaaaaaaattattaattcctctgctatgttatcttgtcccaattcacaaaataacagggatttccccatgtgactcaaaagcaagaatcttactcctaaataacataaacagcaatatgtgtgactactgtcattcattaacttcgatggtgaagttcattaaactgaccattaaaagaacatttgaacaattccaaaagggagcaaggataaatctccaaatcacccaatagacaaggaacccagagatgacatacagtgtgctcacttccacccactgccactgagaacactgattgctctcttcaaacacagagccaagaatgggcctcatgtcacatggggcagggcagctgctggatggggccctgaccccacaaactttggccccggctgcggctggtgctcagactccctcttgctcctctcccaaaacctcttcataaagggatgggtagcagatgggctctcttgcattgagcatgaccaaataatttatgaccttctcatagctggtttcagcgtgggccttggaaccccacaggaactcgtagtgcgcaggatcactgccgggcacctgccggtactccaggtagttttcctgcacccaatcttgggtgagcagcttcctgggctccccgtagaacatgtgctccttcccaacatacacccccatcacactcaacgcttcccagataacctcttcaggggcgcagttgtctttggttaggatcacacccaggacaatgatcaggagggcggccttgggcatgctatgaccatcacccagcatgctatcgcacgagaggccaagagcagtgacaaggatgtaggagtggccggcggggtccacctccttcacatcagtgccaaagatcacctgcatgaactcggaggctttgccgaagatcacaggaaagtagcgcttgtaatttttgatgacgctctccagcatttctgcctttgtgaccggctccttgactcgatatttgtggagcaggaaatgaaccaactcagccaccttcaatttcagtgcttcttggaacatgaactccagctgagctgggtcgaccgaggagcttggctcttcctcttcttgactgctggagccctcatcgaattggctccataaagtgtagtagacggaaatggaggaggaagcgcctccctgaggactctggggaggacttgatgacccagcagcagacacctcctcctccttgctgtcagaggaggaggtagtctcctcctcctcgcctgtgggttcctgtgcacccatcaggcccaagtcctctccttgggcttcaaggtcttcatcaggcttgcagtgcggactcctctgctcgagagacatgatgactctggtcagggcagcagtcaggagcgtgggcaggagctgggcgatggagacccacaggcctggggagagagggagtgtgtgagagacttcagctgagaaccgaaccttggaggttctaacaaaggctgacttacaggtcttcgtcagtgctgctctggggcctcttggggctcctgtcctcctggttagcctgtcccgagaacctgagggaggaagtgagagggctactcagcgtgcagctagcctgcagagatcaaggctctatgagtgacagtagggggaatggggccaggtgctatggggtcccatgtgtgctggggcaggtggggcccttggtgcacattcagggtgaacacttcaccttcactgctgacactgcctgggtctcctctgctctgcgacctgaggacactgtctcagaccaaggcctgcctgcttcctggagctcctggaagaggaatcgaggggcccttaggctgcagactgcaggcagagccccggtccctcagtgctgtcaagagggcgggctggacactcttgagttctacacacttttggggtggatggtcccctctgcgctcactcagggccctgacctttctcctggcagggactggactctactcctctacttgcctgagagtctctcagatcaggagctcacatccctgatatggaacagaaggacatgccccaaccaacatctgcccacacctgcccagggtttcctcggaagtacagtaagagatgtctaaattcaatggggtccatgtgtcctggggtgaggatactgcctggtcctcatcttgatgcctgcagggtctggaaccctccctctgttgacctgaggccctatctccaggagacacctgaagaggaagtgaggggagtccatccacccagcggcttccctcagctgacacaaggggcagggtggggctaggtcctctgtgtttggtgagtggggtcccctcagtctgcacctggactcctggcagggcctgggaccctccctctgctgacgtgagtgcagccccctcagaccaaggccagccctccccgacaccagtgatcccaggataaaggagggacctcagcagacagccctgcccgggctctctggggtgacagtaggggcagggcaaactctcttgatctgagagtttctctggcctggaggtaccctcgatcctcccttaggttcctcacctggactgctctccaatcctgggaccactgtgtctgtcgaacacagggcctccctgttttgtccacacacaccctctgagaacaaagtcctcacctccctgagatccagaaacagaggtgaggaggccccacatatgtcacccctgcgtggggtgtccggggctgaccccaccagctgaacccttcaggtatgaggtgggtgttccaaagtcctcctgcgggttattcatctttactcctgctggggcttctacttcctcgaccctcaaacccttgagatgagcagacatctccctttacaccaacgcctcatccccctgagggttcctcaacttcctgccgtggtacaaatgagcttgccacttagcaccatccttgatcaggcccccccccgcccccagatctaagaacagagttcacctagactctgtggggtggcttctttctgcgttgggggtacctccattcctcatgaagggggcacaccttgggtcctgctgatcctgggagtcctccttctactgaccaggtgtggagccctctgttggatctctcagtgccccctgggatcaaggtactcacctccctgagacctctcacccccagtcacgtgggagaaatgagagcatgcctcatgccattcctgcctggggccacctggggctgagaacaggtgacaccagtgtctgtgaggtcctttcttttttgagagcgtggaggtaccttcttaccttcagtcctcaccaaacttcctccccgtcactcctggaagaccctggattccaccctgtgctgaccaggtgtggctccctctgctgagctgaggaaacccctcggaccaaggcccccacctcccggagacccgggaggcagaagtgaggggccacctcatggtcactcatgcatgagatacccaaggctgaccaaaggagcaggttccagggggcctcgtcggtctgggtgtcctctaggtattcatatttgcttctgacagaatctggccccttccattttgctgaaccagaggtgagtcttgcagaccaaggccaatttctcccttagaccctctttgagaaagtgtgtgttgggggtggagggggcacttcccttcctcaccgtcctgcctggggccttccaagactgacggcaggggcaggtttcctaggtctgggatgagaggtctggtgaatccttcctcaggcctctgggactcctccttctgctcacctgaggccccactcctcataccacagccctgttcccattgacacccgatcccaccagccacaatgcaccacatgcggccaccgtgcccgggatcgcccaggccaagatccccactgagctggactccggggtcccctctgtcctccgtcttgttccttccctggtctcctagagggctgggccccacccctctgtggacctgagtctctatctgtcggattcccgaggctgaatgaggaggggcctcggtctcagataggggcggggtgggccccttgtcctggggtactgggtcccctcaggcctcccttgtctcccagcaggacctgggccctccctctgttctcccgcggccacgctaacgataccaagccccttccctcggtcagcccaggatgcagatatcacgatccgcttgcctgaccgccatgcccggaacttcccagggtccactgcaggggcagtgactccctctatggggcctcagccctccctcagggtcctggccctgatgcctggcagagcctggcccctgccctctcttaaccagtcctgccctggtcacaccaagctctgacccagagtcccctggggcttaagtggtggggtggcgaagggtggcccacagcctgagaagtccgcccccggggtggttcagggctggcagcaggggtgctgctggattatttggggccctctatctggggtgggggcgtcctcagtcctccctcagcgtctcatcttgcctcctcacagagcctgggcccgcttccctctgccgatcttcagccaccactcagaaccaagcccttgctactctctgacccccagtgcgcaagtcagaggccttacatccgggcacccggagcttccctgggttgacagcaggagccgaaccggattctgccacgggagacttgggggtggggtggagtggggggggggtgaggatggaggtggggaacctgaggctgtaggtcatggtggtggtggctgggttaggggtgtggaggcgttcagccctccctcagggttctgaccttgatgccagtcagagcctgggcccagcctgatacgcccgaccccgcggggtggtccagggctggcacaggggcggcgctgtattatttggggtcctctatctggggcggggggtcttgagtcctccctcagggtctcaccttgcctcctcacagagcctgggcccgcttccctccaccgatatcgacccgcccctcacagcgaggcccccgctactctctgacccccagtgtgggagtcactggccgtacatccgggcacctggggcttccctgggttgacaacaggggcggaaccagattctgccgcgggagagttgggggggtggggtggagtttggggtggggtggggtggggtggggtggggtgtagagtggagctgaggatggggctggggaacctggggctgtaggtcatggttgggttgggggggcccagcctccctcagggtcctggccttgatgcccggcagagcctgggccctgccctctcctaaccagccctgccctggtcacaccaagctctcactccagagtgcccagcagcttgagcggcggagggagggggtcggcccagcctcacaagtcagccccagatcggcccccgggtggtccagggctgggagcagagacggcacttggttctttcgggtcctctatctggggtggggacatcctcagtcttccctcagcacctcaccttgactcctcacagagcctcggccagcttacctccaccggtatcaagccgcccctcagaaggaggcctctcccttctctctgacccccagtgcgcacgtcagtgacgtcacatccggcccccaagcctggagcttccctgggttgccagtaggggctgaaccgggttctggcggagtaggggtggggatggggataggggccctcagtcatccctcagggggtcctgaccttgatgcctgggtctcgatccccattctctgcccattgggtctgctcctctcggaccaagtctctgactcccagtcacatgaggtggcagtgaggggaggggtgtggtcggggtgacaacattgccagggtcttccagggctgacaggaagggctgagctggattctgtggcccctctatgtggggaggttggaccttcagtcccctctcaggagggttctcctcctggctcctggctctttgatgaagtgatgtgtgggagatgatctgtttatgtcacctttgagcatttgcccagctgcacgcgttgcagagaatggctgcgggtcccaggctagatgctccctggggggctgcagcacctgtgattgtaggacctgtgagagaagatgcacaccatcccatgggggctcctccccagccagagctagactttgcaaaccttttgtcctaaaagatttatttttacacggaagaggctgagcagcagcaagagatttggagaagccatgtgttttgaaggtatcgaacacagcagagtccagattagcgattttcatattttaattctcattcacatggtaataaattttacactgtatgtgtacattatatatggtattgtacattttgtttatatctacgtttatatacatacctgttttagacattatatacatctatgcttatatgtatacatacacgcatatatatctttatatcttatatttacttacatgtatatatctttagctacatattcgtttgtatttctagactttatactatatatatgcacacatattttattaatatctactcatagtatgtggccttcacacatacttactattctattcctagttcattctttatattccattaaaataataattttttggaaggctggtcttctcctactaagtttgtttcaggtggttgttagcagaactctggagccatagtgtctcaatcaactcaaatttcctggtgtcctgatattactccagggctactggcatcagattttgtggtgctgcctcagattgcgcgatgatgtggggtggaatgttaaacactttctcctatccatcctgtaatctgccatctatgcagggtacagacctcctcgatttccctgctgctccctggacccaaaacacaagtactagtttagcacagtcttcagtcatccccagggctttctctgttttgatgggtttttttttttaatcttttccctcctatattttttccggggttgatttggggagcagagcacagcaacctgagcttggttgtcactttggcaatgacagttaaggcactcactctgtatttaatttaagtagcatttacatctttgccatattctgttccccatcaaggaatatggtatacagatccatttacttgagattatttcctgagtctatcagcaactttgcacagttgcttccataaaggtcttgtcaggctcttcttatttacattttggattttaatgctgctgtgaatggtgcattttctattttctattttatatactaagttgcttttgtgtggcaaggctcttgattttgctttaatgaccttctgtatgatgttttctgaagtcttttattcatttgaatattcaatgtgtctattcctttgaattttctatgtagataatcatatagttaacaaatactctatttctttgcagtcttcatatctcattttcatcttgacatccatagctctggctctttttcattttgatattcactgcagatgtaggtggtagtggtgacagcatatgtcaacgacttgtcactgccgtgaatggcagagcttctgacatttcacatttatgtatgcttgctgccaattttaggaaatggaagttccttttaatgttagtttgctaaacattgttaatttgtacttacatagaattcatttcagagccttttcctgtacccattgtcatgactgaatgtttttttctagtctatcttgtatgcagggagttagaattgaatttttttctaacatttaatcctatttttattccatgcatacaggcagcttgttcgtttaatccactgttgtgttggatatgtgattatctgtttatgacatttgctgcgatgtgtgtgaacacttgcctcacaaattcttttcatgagtgctcgggtgccttcatctgtttatgaatctaggagagcgagcctgggagaatgagttaaacaattgcccattttggatgcattggaagagttgagataagatggtgattcattttcccttgccacttggctgaactggcctccaaaatttcctgtcctggaatatttgagggtagattgaactttgaatacactttcagtttgtggaagtaccattggttttatccattcacctcttcaaggacatcttggttggtgattatgaataaactactaatacattcgtgtacacgattttccatgtgagaaccagtttccaattcacttaggtaaaacctagtagtacgactgatggatctaaaggtaagtctatgttttactacataagaaagggccaaaaggccttctagagtgaatgaaacatttttcttgtctaccagctatgaatgagaatcccacatcctctccagaatttgatattctcaggtatttgaattctatccattgtaataggtgggtagaggaatcttagtgctgttgacatttgcattattaatgaataattatggtgatcatcttttcatgtgtgtatcttcattggtgaatgtatgtgtatttctgcgtgtcttcattggtgaatgtcttcaaatcatttacatctttagttggattctttgttttcaaaggttgaatgttaaatgtttggtatttattcagcatatgagttctttatcagatatcagattactaatattttctctccatctatatagttttttccattcttctaacagtattttttttttttttttttttttttggagatggagtctcactctgtctcccagcctggagtgcagtggcgtgatctcgactcactgcaacctctgccccctgagttcaagcgattctcctgcctcagcctcccaagtagctgggattacaggtgcctgccaacgtgcccggctattttttgtatttttagtagagacaggatttcaccatcttggccaggctggtcttgaactcctgacctcgtgatccacctgcctcagtctcccaaagtgctgggatgacaggcgtcagccatcgtgcccagctgagattcacaggaaaaccacgatcggaggggtgtaagtttgtaggaaagaggtttttaagtggcagcatctttgcatgattcaaactctggaggcatatgcataaagtccaagaaacacatgagaaaactgtacttcttggaaactaaggagctcacaaatgatgaaatgtgattcacaccgatttgtaaatgagcacccatttgtaagtgagcaggccgagacagggagatccacctgcagaccatggctggactctggattaatccattcccatgtctgcattctcttatggcctcttcccacgtctcccaggactctgccacctactgtcaaattaaaaatcacaggcagggatacctctgggttctggtgtgtgggtgttggggctctctgcacgccctgatttcagagctcttttgatgtctgtgcccagttgtgtctacggtaagaacttgaatctatttcctctgatcagtcaaagaagttcgtcgatgatagcatgtgttctaagatgaacaccccaagtgagcagaaaaggctgcttcctaagttaaaacatgacatgacatcttttaaattaatttttgactccaaaagaaaggagaaggaaggaagggagggaaagagagagagagagagacacggaaggaaggaaggaaggaaggaaggaaggaaggaaggaaggaaggaagcaagcaagcacagagagagagagagatggaaggaaggaaggaaagaaggaagcaaagagagagagagagaaaaaaggagaggaaaggaaagtaggaaggaagggaaacaagaaagaaaaagtgggggcatagtgggggaatcaaggaaggaagtaaaaaaccccaccagatccagtacagacataaaagccaaacataaatcctgtccaccagacactaatgagcaccctctaaactgcaaacccgtaggactccttggtagtatgtgtcacctccacaactatcaagggcactttttaacccaatgacaaagccagacgtgatctcatctgtatgtaaagtgaagatcctgttatataaaggcaccgccatgacaaggaatggccagtaacacagagtcattgtgaaccctaggccggcaatgctagcagcacaattagcactcagcgagcaactccaggtaattttttttttttttttttttttttagacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggcttcctaaaacccagcacctgctcgagtatctcctgggcacttttccagggaggcgtgttaggctgaagtctctatcatgcaagccaaagatgtcggaggggggtactggactgcaaagaaagaaaaaggatggagaccatgaagacttttttgtgcagtcagaaaattactcattttctgacacatttattgaccagcacatattctgcccaaatgctgccctctatgtgctctggtctgcgtagtctgggtacgcctggggcccatcgctagctggcatgtactgtgacgtgcggtggctgtgggggcaatggtggtgcagagctgggagatgggggaacatgaccatggaggcagcaggctgtgcagccccagcagccactagggtcaccggtacccagagatggcaaaagggcagcatgccaggtgcaggaagtcctgtggtgtccatggcaagggtactacgggacgctgtgggaagggccaccacaggcccgtaagaattcatctgagtgggagatccagggacatagaggaagggcagcgctgcaggcccagggacagcggccaccggagtgacgtgagcctggctgccctctgaccactcgccggccggctgggtcactggactgttgtcactcgccacggcggaatcaggcaccatcacaggagttgctggtggagcagagccactcctgatttgggtgttgggaccggccggttcccggtgttgcggtgtgacctggtcattctcattcggagacgtgtgatcttgttgctcagtgtctgctggtgccagacaggatccagcagcttctggcttgtcctcctcctgatgtcttggtgcagacttgacacccactcttctcttcatcctcacgaggaggtgaggggagtctctttgaaagtaaggatggcagtagaactctaactataagtcaaagtttaaataaacaaaaggaaactgcaagtcacaaggatggactacaactaccaaccatctacgcccctgtgcaagagaactctactggcccaggaggcctttctggaaaaggtcccagtccccaaaggaagctggggactcgcgttcacatcgtcaaggtttaccaagttgtggcgggcctttccgtcttggaaaaagcctcaaaatggcagattagggtgtccatggccggcggaaagggtctttgaagttgcagaccaggagggaagaagattctgggcctcccccatgcagtgtcagctggcaacagaatgcaccccggctgggttggaggccctgggtactggctcttccacaccaggggcccacctaccaagggcagcaggagcatctgcacctcctgcgccaggcgcccttcagtgcttccacttgagcacctctccagacaccagctagggtgacagtggtacaaataccagactcccctggcctgctcacctcacagggtaatgtgctgtggagtcagggggacacagcaaccgccagatgacatggctggccccggggaggacgacacgcagatacggctacttggcacctgtgatattttacacactcgagaggggcccgcaccatcctcagccctctccccacattcactcttagttcatgtcacctccacccagagggggacacaggcccacagcgatggccccacaccctgcctgaggtcgcccacttcccaggaggcagtcctgggacttccacccgaccaggccccagagcccaccgacttaacccctccagaggcttgtcgttcattaccttattcaagatggagaccagcctttttgcggagaaaatgcgggtgaaggtcctgaaagtgcattgacgccgttttcggaagccatacaagtttagctggcggaagaagctctttatcgaagttgtggcaaacactttgtgtgcgacgtcccttttgagaatctccttttcaaagagtttttgattgatcactctacaagccccactgtcatcccaccagatggacgaaaactggttgctgctgaccagtctccacagtttctgtggaaaggggagggagaggagattatcttctccctggggcgggacgtcaccgtcagggtgcggccttctgaacgaagcttcctcggccagaggttggaaagcgatttcttctgtcagcagcctcaagttagggctcccagtggaccccgggtcgtcccaggcaggggaaggatctgctgggtgaaggtaggtctctgactgcaactggggagggaaaggcaccctttccaagccatgatcctgtcctctcgaatttctttcttcacagcgagccatactcaatgatcgcttgtcctccatctggcaaacttgctagtgcagtgtggccagcagcaccccttggcagtcatgtaaccagccccatgacatcataaaggggctctgactgccggggggtggcatctccacccccagcaagttgtgtaataaagggccaaggcagacaagtagctgcccatctgcatgtgcacattctggtcctcacagtcatttcaatgggaaagatgacactagtgcacaagagtgccgaggggccctgccacaccgtagatgcagacctggagcggtccccttgtcctagagctcctgagccaggcacaactacagcaaagccctggctcaggaaggtcagagctcaccgtctgagtcatgggcccacagaccccagcacatgactgacactcggaagcacagaacaaagggtaggacggtgcccatgggtcaggctgtagccacgccaccctttccaccctgtcctagccagaggcagcaatgtgctccatacagatcctcctaacacacccacactgtcggtccccagcacgcagatgcccgacagccccttaggcaaatggcttagctgactgccccaccacacgccgtcgccatgcagtccagtggggagtcggaggcagcctccttcctgcctctcctcggcctgcacgtgtccccccaccaggcagagacccttctacaccccgggtgtctgcggtcacatcgcggtggggcatgcagctgttggccttcgagcatgttttgttttccttggccagtgtctccagagaaacgcacgtgggtttgtgtccagcggtccatctctgcaacagttgttcctttgggattggatgctaggaggtcacgggagaggtgtccatccaaagcagtgtctgtgtcacacactgtccccacacacagggccacctctgcacagactcccccgactcgattctgggcacagagctcagtgaccttccagagactgccacgaaccggtgatgcctccacgcttgagacatcctgaccgcagggcccaaggcgcactggctcagggggtgacagtgaggggtctgcaaacagactgctgatgctcaacccggccgctgccgagctgtgtgacttgggcacgtcacttaacctctctcggcctctgtctcctcccggggataagagtagtagcacctgcttcccggggctgtgaggatccagtgggacgtataggaactagcgaggcaccggcagttgggtcagagctactgttgtcacttcacaaggcattttcttcaacagcaagtcggaaatctcatgagcctaaggcagaatccacctgtggcctctggttacaacccacaggactgaaaatccttccagccacagcaactggtgaatttcctggtcaattgccacaagtcatgagctgaaccccacttgagtttcagttcaggcagaactctagagacgactagggcaagctagacagcgactgcagagccttttgttgcagcgtgagcagtcctcagctgttgacatcactggggagcaaacgaggaccaggagcggtgaaaggacagtgtctgctgcagattgtcgtagcacccaaggaacactccagaaagcctcctaagcagtaacaagtgtggcaaggtgtagcccagccaacagtggcatctgcgaggcgtcccctccttcctcccactaccccgtataccctgggacctgtgcactgaaggactcattctaaaggctgtgcccctgcagccgccagcctcactcactggctgcctgtgccagctagagatttctttcctctgaggctggctgagaggaccactccagtttcctggcccatccagcaaagaagatacacatcatgcacgtgtaaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttcccacgcatagtcgtgacccgcgtggccgtttctgctctcagcaacattctctagtgttccggcttcaagcagcgcttgtcaggtttgaagctagccactattctgagaacgtcagaaaagcatggaccatctcttgcttggtgttgccgttgtggcagtagcagctactacgtacctgcacgagttccagggcagaagtggcaatgtcccatgaaggcgtggcaccccacggggggggggggggagtgtgccacgggcgtccacttctgcagcagaaggcatgtgcctacagcacaagcttgtaaaaaaatacttgaacagaatatgctgtacagaactaggggttaacaccgcatatgaagatgctaaaacatttgtataaatactctgtatacaagcatggagtcactcccgtagaaagggctcatccgtgaggctatgaaaaactgctgtcagcatgcccaaagagaaactacttccacagtaggaacagaaaaaaggactgtgctgtgtctaaacacgtggtgcatcagagacatagttacagttcctactgactgccccagccacgacctgggagtgctgaggacctgggagtgctcagcgagctgcaggaggtcagccctgtggagaaatacatttctaaacaatacttttgattgggatttcagcaccgtatagacagatgttccttctgggggcctggcaagcagccatctcccagtgggtctgacggggaagaggggtacctggagcccctcccagacagacggtaatcccacccctgttctcacactcttcctggcatccgcatctgctggcacacacccccgtcacctgccacttccgcgtcccgtcgtggtgagtggctgataggcgctggatgcaaacaaggcatgagatggacgtacctggagacccagctccagtactggttctggtctgcggggtgaacgagggggcagaggaaggcggagagagtgcgtcccagtccacttaagctctgtccccggaagtggcatctaatctggcatttcgatatttaatttgggaggtgggagcacatacttcccagggctctgggtaatgaccaccctggccttctttcgaaacatgggtgcgattttagggggctccggaactggggtctcttcggtttcttcattatcttcgtgatggagatcataggaaatgtttccatattctcgtagaaatgggaagatttcaagcagaaactgacagaaatctttgcggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaaatttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggttggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagcggccaacagggacctaggatgaatcccaggtttgggtgggagatgtggattttccatcaaaccctcccgggcctgggaagaatctgtcttgatccccattttgcagaggagggaacgggatctctgagaggttgcctgccgtgtctggttctacctcaaatggcagcgtgcactgcgagaaaagtcccggtgcaggccagcagaacaccagagttacggcatgcccttcccttagaaggtcccagaatttcctcagccctcactttcccacacaagcttctaaattggggccctcggggactcatcccttcctagacttctatccgccaccccccaccccctggtccccccccagacacacaccaaggacttctgaaatgctgagtacatacagtggtttcctcccttctgtccaaatgtggttgccatcagcgtgatcaacgagagccaaagggggacaaagatcgggatgcaggagaaggcgttgtggccatccagtttgtgaaccagcagaatctaaagaaagagacatagtcccggttgatgccagcaccgaaaatgggcagaggcggaagccagacttcattaggcagttcctccccaccaccccacccccgcgtgagctcccacaagagggaacatcagcaccgccagaaaaaggcaggaaaccacctatccctggggaaagctcgaaatgagcttttatgtccctcttcagagctcggcaatagcctatccacttgaaaagttcccagtgccagcagttttatggcaaactcctccgggtgtttgttctaaggagtcaacagctcccattctagaattctccacgtgactccaatacacaaatctgacatcccactctgctttccccagagtggaaactggagccatacagaggcaccatggctaaaaaggtgcactcttctccctgccagccccacgtgctgcccccaagagaaaggaaggatgctctcctttcaccgaagctccctctcggagatggctgtgttctctcccctctcctggagtgggctcactgtgagctcgagggacagaggctgcctttctaggggtgcagaatcctgtcaggggaagcgcaagcttcaggggctgaagaggcttcccgtggaacgcttacctcaaatgtaagaaggggcacgacgatggtcatccagctcagggccatggttatgtgtgtcctgcgctgctccgcaatcacatccatagagcgcaagaacaagacggaccacacaatgtagtagaggaccaccaggcacagaaaggacatgagaatccacagcgggacacacacaacctgggggtgggtgagagaacagcaagagaagtctctttagagcttccaacctggcctctgatggaaggcatctttagcaccttgctgtgtctgtccagttaaggcggtccttcctgtgagccgaataaggaccgttccatctcccaggactgctgggagcatcgctcaggacagaaaaggtatggtatgttcactatggggcctgctgccaccaggggacacacacgctcagtgagtcatcagtccctcttcctttgggtgacagacagccctgcacctggctccgcagcctctactcttccagaggcccactctcccacactctctcaggctcctctaggttctgctgccatcacagcttcccgggaaatgggacacaactgtcaccctgtgcacacacacaagatctcaccccaacagactctcttcacaggcaacattcccacaacctgctgggggtactttggcaacacaaatgggaatgggctccccagaaagtctggctgcctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcacacagccgttggcaggatgcagaagaggtctgtcaccctgcaaaactctccgtgctgtcccttcactatcacaccgtccccaccattagccccggcaaacactgatctgttctctcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagatctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtcttcatttcattttaattttgaggaagtccaaatttatgatttctctctcgtatggaccatattaacagtgccatttctaagtactctctgcctaattgcaaaccccaaagattctgtcctatgttatttcctaacagatctatagttttacattttcttttagatctatgatttgagttggcatacgaattttacttctcctgaccagttcttgattgtaggtttctctgcagagtctatgcacagcctttcttccccgttccccattctgtgatgagattctcctttttactgaagttcccttcatgggtggaatgttagatctcaataggcttccttgttttctcttgctcactatgggaaacatgtactcagactgcttcatcaactgggatctacagaggatgaagggcagaaaaaatctttcttctcatttgtggaaagctctcaaaattactaatcttttttttccctgacagtatcttatacgaaaaaatttggtcttgtttagatatgtttccttcacgtcacaacagaaacagttttgaacccaatgaccattctccagatacagcactgtgaagttgtaggatgagtgactgaatattttttattatgaatgttttatcaaagactttgggcagaagtgattattcccatctttaaatatggagtatacttaggttcccttcatttcttctctgctcccaattctttactatacttttcactttttaagggtagctatatttaatacataaaatatattgtatgcaaaattatacatcaaacaacagagaaaataaaaccgaacaaaaacactagcatgaccttacctcccagtggcaatggaactcttctgcctttagtctccatcttttttccatgcatttaatagtggaatctatactgtgttctctaatttctaccttgccacttatctttctatctctgcatccatctacccatttattcacagttaatttcaaccaaatgcccagtaactgaagtcacagtttagaagcatgacatagatgccaccaccagcaagagtgtaaatgggtatggctttttttttttttcttttgagacagggtcttgctacattgcacaggttggtctcgaactcctgagctcaagtgatcagctcacctcggcctcccaaagtgctgggactgtaagtgtaagccactgcgcctggccaggtatggcttttggaaaagcaagttggcagtgcagtatacgtatataggaatctcaaatagttcccaacctctagctcagtaacactatttctggactatttcctaagaaaacaaccaaaaaacaaaaggcaaaaattttaatgcataaacatatatactgcagtatgatttaaaatcattcaacactggcaacaatggaaataccatattttagaaataagaggatggtctgatacatgcacttgaagaatattttgtatcaattaaactttagaagtcatgtttataaagaccttttattaacatgataaaatgtttatgatacaacattaaaacaaaaaaatcaggatacaaaatggtgcacacagttatatccaaactgtttgtataaaacacagacataaaaacactaaccatgttatctccccatggtgggattatgggtgactattaggctattacttctgcttgtccgtcttttccaagctttgtacagtgaatatgaattacttttataataaaaaagaagtttatttaaggattttaaaagttacatacaagccagggccagtggatgatcttgtccagtcttaaggcaatgaatataaactggagaatgttgacagaacacaggatttctaactaaaaatgaagagaagaatcagttaaacaaagtataatttgcatttaatactgcagtaatttggttaacacactaaaagacaatacacattataatacagtgtaacttgtataatattatattgcactggaaactcctgattttcggtaccagaggggcacagcagtattatggcaaggggaaatggggctcagcctgctgccttgcccctctgctgccttgccctttctggcctgaggcctgagcacagatgagaaccttgtttccaggttcactgggaacacaggctagctgcaatagaccactaaacttccttcatgtccctaccaacaatactgtctactcgaaaccatccttgtgcatccttcttctcatacctcggttttgcccttggaccccaccccttcctttcaggctccttgaggaccttgtcacatcaagccatcaactgtagattccgtactgtatctttaaccccacctattccattgatccctcctagcagcacagaaatgactccttctcattaaaaacaaaagccccgaaaccagataaacccaccccatcctttgatccaagacccctcttagcctcaggtttctctctgcgagacagtaatgaatatgcaagcccctactatctcatctaccattcccagcttccttgtgatctggcctccacccccatgaccaccagaagacagctttcatcaaagtcaccgataaccgggaggcagcaaaaacacttcaactggcatcctactgatactgtggatgactctttcctttttgctcccctcctcctggccatctagatcccaccatacagtcttggagccctctggagtgttctggtaattccttctgtctccttttccccctccttaaatggtgatgctccgcagagccacaaactcagtcttctctcccgactaggaagacagacacacaaacacacatattttcactcacccgctgcaccctggactgggggagaagaaatttcaaccagacccttggtctgcattattacctccttcatggttagttctcacatctgtctccaacttagccttcctgctgcatagcagacccagctgtgcataggccactcggctctcctaaaggcacctcaaatgaagccagtcccaaatagagatcattatcgcctgcacttagaaccttgtatctcctctttctatagcctcccatgtcactttctatggcctcccatgtcactatggcctcccatgtcactttctatggcctcccatgtcactttctatggcctcccatgtcactttctatggcctcccatgtcactttctatagcctcccatgtcactttctatagcctcccatgtcactttctatggcctcccatgtcactatggcctcccatgtcactttctatggcctcccttgtcactttctatggcctcccatgtcactttctatggcctcccatgtcactttctatggcctcccatgtcactttctatagcctcccatgtcactttctatagcctcccatgtcacttggaggcacaacagtggtctcatttctcaagccatgagcccgggaatcaccctgcattctttttcccacactgtcacgttcagtcaccacatcctgtccactgtaaagtccagatttctcctgaatcccgtgcccacttcctatcctgatgatgactgcctagtgaggccttcttcggcaccatccgcctaccacttcagcaaccccttactaacctcccgcctccagcccaaacgccctgcaggctgctcctcactctggtaaagtacattcttgcccacaaaattgaaatctgggaccaggcccagagcttcccaaaagttctcagtacataggtacatggggaatttagtaattcctccatagacctctaggccaaaagaaatccctaatgtggctgggaatgccaacagttgcactgatttaagtaattacatctaacttagtaagtatttctaagtagccactagaaaaaataattcatataaatctaaagaaaaatgttaatattattcttaaataaccaaaactaattcccagtgggatgcgtgtgcctgtcaggtagctcaccatttcccacgccttggaatcagacaaggtgctcccactcgttacctgttcttcacccggattttcacacagcattagccttttttgttttcacagcaactgctgaaaacccagcttcttaaagatacgacgtcactgaaaggaatgcagtgtggcctaaaaataaacctgtaaactatttcaagctagtagtttgtatggtgtcccaacaaatgtcaggtattactgttttcctcaaaatgtccactatcccctggtgccctgtgagtgcactggggtgcctggggcacttcagcacatgctctgtgggctgaggacgtggcccctatttgccccaatccctctgtagaggctccctctcttctcaactcccacagttccttcctttccaccttgtgctcccgtcggatctgaatcgccacagtccactcagctgatggagtgtttcctgcctctaggcttcaatgtgtcccaaaaatgccatcccttccctcccaacacagggcttcctggcagaccctcaactcctccttcccatctctgtatgagcctactccagaccaccccctcaccaacataggtactgttcttgcatcacaggaggagggagctcagctcctggtatgttgtttcttccaagggcaggaatgcctagagtgtgaatatatgaaagacttactttctgtaattcaggcccaatgcagtcctagtccttgtatagttgtccctcagtatctgtgggggattggttccaggaccccctgtggataccaaaatccatggatgctcaagtccctgatataaactgggaattgtagggagggtgaaagtggaccatcagatactctccctccacggctcactcctacctaccactatacccatgctgtggcctttccaccagcatgaaaatcagggaatagctccccttgttcaaggccaaacccttcctggtgctctaggtcccattctccctgagtcccacagggccttgctccatcaccgtccctctgtctacataccttcccctcacgcccatacctggggtctaggcttatatgcctgacccaccctacagctgctatgtttacttcctaagccaactgcagtcttctcccttcactcttcatccacacggctcaaaaccaggcatctacagcctctagttctcccctcaacccatcagtattcagctttgggccctcagcttctatgcagttatgtagttatgtgcccgggctttagagtcgggctgactcaaacggaatcctggtcctgccccttcacatgtggccatgaacaaatgacttatcttctctggacctacctcacagagttagttagtaagaaaactaccacatgtaatgtgcctcgcacaatgcctggcacacagtaagtgctcaataaacgttatctgcaattactttcattactattattactagtcctggtattttattcatctgcatatcctctatgcttagggaaaaagggcttggcatctagtaaatacttgataaatgtttattgaatgaataaacaaacacaggggcacatcaggataagctaaccagacagcaggggaggtgctaaatcatggggtctgaggtggggagatggtcagttttgagtgtcaacttggctgggctatagtacccagttatttaatcaaacactaagcttgctgttgcagtgaaggtactgactttgaataaaggagactaccctccatagcatgggtgggcctcatgcaatcaggtgaaggccttaaaagcaaaaactgtggtttcctggagaggaaaaaattctgtgccaggactgcagtgtcaactcctcctaggtctccagcctgttcacctgccctggagatttcagacttgccagccccacagtaatgtgagccagttccttaactctctttatacatatatctgtatctaacctatcagttctgtttctgtctgattgatacaggatgtgaagctgggagaaggctgatgtcctgggtgaaaagctagtgttctaagtgaagaaagaaaaattgttatttccatcatcttttgttgccttgttgtctcatgatgtagagttggtaatgatcaagctcttcctaacaaagggtaagaaattgacatctgaataactgagcaaaatattttacttttgaaaacattctttttttttttttttaagacggagtttcattctgtcacccaggctggagtgcaatggttcaatcttggctcactgcaacctccgcctcctgggttcaagagattctcccgcctcagcctccggagaagctgggattactggcgcatgccaccacacccggctaatttttgtattattagtagagatggggtttcaccatgttggccaggctggtctcaaactcctgacctcaagtgatccacctgccttgacctcccaaagtggaaaacattcttaaatatatgaaatctcacctctagtgacctgtcatgtcgaaagccccaaacgcaagctgcaacagacaccggggaaacaaagaacagcggcatgaagaccaggagccagaaatggcttcctctctcgattctgtcacagaccagaacttcaaacatcaacaagagcaagtggatgcccactgcaatcaacatggctttaaactccacacacgtttctccttctgctctaaaaaagggagagaagaagaaaacaccctcagttcagaatctccactataagcaagcagttcagggcaaataccaacttatatttatactttgaattttacttgaaaatttgacaaaagcaaagggaaatcaggtagaaagctaacttaaacctaagctttggtaggcaatctctgaaacatcgaagaactactacataatacaaaatgaacattacaaccaaaccagaatttaatgttttaaccgtataaggatattctcaaaagtaatagccagttcttatttccctgacaatgtacataaacacttctgttcacatctttaaattcaacaacaagagttacttccaagattattcaagctgatttgcttctgctgctaaaaccaggcaaataccccttaagtctcatgatcctcatttttcaagaaaccatgtaaaccacccttcacacaatattataaaaataactctagttctatgaacaagtgccagttatatttcaagatagtagtaactattgttaggtgctatttttaaatgcaaataaaacgtataaatgattttcattttcctttctattccattaagataaattaacacctgcacatgaaagagaaagaagaacaagagttaaaactgttctcaaacaaaatcagtttaattagctaagtatcatgcacaataaccttaacagatctacaattgagcaatggtaaggccgctaatcaggaaaaggctctataatgcatctgaaaggcctacaatgtttattcaaaatacagatgaacatttatgatatacatgtattgtgggtgacaaatacaccggaagttagatcatagagaaaatgctatcagaggttattcctgtaggacccaaccatgttccactggttaatgttaacatgagaatgaccacgcctgtacattccttacattcaaccccacatacacaattcctttccttgctcaaaacatcttaaataagaccaacaaagagaagtttgaatatattctaaatatcaattagtagaacctaaatgtttatttaactttgcattctttgagaagcaattaatattagatatctgaaaatatctcataaaaaaataaaacacatacagccacacaggtcatcaatctttcaaaaaaaatctaagaactctgaaacagctatacatgaatgtccctcacctgccaaggctctctgtgtaactgttttacagttcttagacatgtatgtgatatgtaatttacacaatctgaatcattttcatatttagtaaacaaaaatttaaaaagttgatgtagtggccggacgtggtggctcacacctgtaatcccagcacttcaggaggccaaggcgggtggatcacctgatgtcaggagttcaaaactagcctggcatggtgaaaccctatctctactaaaaatacaaaaaattagctgggcatggtggcaggtgcctgtaatcccagctactcaggaggccgaggcaggagaatcacttgaacccgggatgtggaggctgcagtgggccgagatcacaccattgcactccagcctgggcaacaagagcgaaactctgtctcaaaaaaaaaaaaaaaaaaaaaaaaaaaaaaaggtgcggtagtttcaactttacacttttcccacatgagcagctgccttctgggaattcctgtactcctcattttcccagtggaggttcataatagcctcccagtcttaagtccccctttttccctttatgtagttacagtctctgtggcagagaagggaaagactctcgcaggtcccagcaacaagcaggttgcatgctggcgtgagccaactcccaggaatttgggccagcggaggcatccaagagcagggagggcaagagttggaaacggtaaagggtacccctctcccctgcccccaaaggctctgctttccttctcggcatccaatctttgactttcctcattccccagctgctgtctcagggactcatggtctcctggtcaagccacctcccctacactgctaatagtcctaaagctctgggactaggagggtgggacaaggggagccccagttccaaaactgtattggagaaagatctttcatgaccaaacataatatgagtgtcttttcctaaaaacagggtggtttcatgctgcttagtctagtatggcataccagttctgtattttgggtgcattttggattatataggcatctgtgagctggctggcaacttacccccaaatggcactgcttttgtaagaaaatacataccaaagactaaattttcaaaaacacagaagagatctgttagcttatactatagttctaagaccccagataggtagaaaataaaatggtccttacttcatcaaaagtgagaaaagtcaagatattgctccctcatgctagagaccaatgggttgtataaagcagtattaccgatattgaggatttcgtgcccagactccagttccaactgaggctccaacaatgaccattaacttccacagccatattggagcaaagacagcccagtaactccactgtatgatgccatccaaacgaagggccagcagcacagagaacagcagcagacaggcatagatgaggaatttactaggagaaaagtaaaacgattaagaaggattcacttttacaaatatgtgatactgaaatggggagtaataagagccacatttgtcagcatgtaaaaggagtcactaactcaataatcatttattgaaaaggtctatggggcagacataatgtgttgggaataaaagaaacataaagaagactaaaataagtctcctgctttccaaggcttcctcatagaaggaagaccacacagaaacatataatacagcacaatgtttgtgatgagagcttggaagaggaaatacagactgtgtctgaggaggcactcagaagcagagatgtggtgaccctagagctggttccagagggcaagtaggaagctgccaggcaggaaagcaagtgagatgaggaagtattccaggcagaaggaactagctataccaagacacagagactggaaaaggctgacatgctctgaaaatggtcaagttctatcactaactgattctatttctaaaaaggcagccatctgtcatattcatatggcatgaacattttagtgtatgtattatactttccatgaatgaataaattacacatacacacatgctcacgtctcatataaaagggaattgctacagaggatgtccttgaaataattagaaattatactcttgaggacctctatttccagccttgacttaataataggaatataatttaccttcccgcctaaataagaagcttgatacagtctacaaaagaacagttttcagacattgacaacaggcagtggagaacaggtgagaaggaggaaataaaggaggtaaaccctactattgccccagtttgcagatcagaggcagtttccaggctgcagcaagaaaacagttaaaactcaaccctgtcaataactatattaaatataaatggccaactgaaagacaaagatgatcagattggataagtaagcaagacaactatatgctgtctgtaagaatcccactttatctatctataaagacacagatagattaaaagcaaaaggaaagaaaaagttataccaaataaacactaaccaaaagaaagctggaatgactatattaatatctgtttagtcttccattgctgctgtaacaaattaccacaaacttagcagcttaaaacaacgtaaatttattatctcacagttctatatgacaaaaggcgagacgggcttggttggtttctctactcagaatctcacaaggctgaaataaagatgtctgttggtggaatgcttatcaggggactctggcagaatctacttctaagctcattcaggttgttggcagaatccagtttcttgtggttgtaggactgaggtatgtgtctctttgcttgctgtcacgcagcagctgatcttgcgatagtaggggcctctcctgggtccttgtaaataggcccctacatctcaaagccagtaacaagctatagcatattcaatctttctcatgcttgggatgttttctcactacttctgccatatcgcttctgcttccactgagagaaagttctccgcttttaagagttcatgtgatgaaactgagtccacctggttaagccaggctactctccctattttaaggtccataactgtggttggtaggcagaattctaaagaagtttcccaggattcctgtcccctgattattcaatcaaacactaatctgagtaatactgtgaagggactttgcagatggaattaaggttactaatcagctaactttacaataggaagattatactggattatccaggtgtgcccagtgtaatcacataagcccttaagaaagcagaagagtaagtcagagaaatgtggtggaagagagatgaggcagaagtcagagagattccagacttgagaaggattcagcctgttacttctggctttgaacatggaggtaaggaaccatgagccaaggaatgcaggcaggcttcagaagctgagaataactcgcagctgacagccagcaaggtaaatgggacctcagccctacaaccccaaggaactaaattctgacaatagcccaaatgtgcttgaaagcagattaatccctggaggctccagaaaggaatagagccctcctgacactttgattttgaccctgtgaaactaggcagaagacccatctgagttgtgctgtacccggacttctgacctaaagaactgagagtaatttgtcatggtaacagcagaaacgaatgctaataaatatagcttcaaagtcccctttgccatgtaaaataataacatattcacaggtttcagggcttagggcctgggtatctgtgtatttgtgggggtggggcattctgcctaccacaacataagacacagtatatttttgaacaaggactatttccagggacaaatagaggtagttcataatgataaaggggtcaatttgtcatatgcctaataacaaagtttcacaatacatgtagaaagtactgatcaatctaaaaggagaaataaaaaaatcaaactgttataaatggaaattaacattcctttcttagtaactaatagaacacataaacagaaaattactaaggatatatatgattgtagcaacactatcaaccaacttgacctaattaatattaatgagttcctcccaacaaaagcaaaatacagattcctttcaaacacacacggaacattcaccaagatagattgaattctgggccataaaacaaagctcaacaaatttaaaaggactgaaatcatacaaagtaaacaagcacaatggagtcaaactagaaatcaacaatagaaaaatatctggaaaattctcaaaatacttgaaaattaaatgccacactgcgaaataatccataggtcaaagactatgaagaaaattgaaaaatattttggactaaaggcaaaaacacaatataccaaaatttgtgagatacactaaagcagtacttaagggaaattttagcatcaaatacttacattagaaaagatatcaagtcaataatctaagattctatcttatgaaactagaaagaacatggaggtaaggaacctccatgtaagaaacggaaggaaatttgtaaaaagtaaatggaaagaagaaaatgataaatgtaagcacattaatcaataaaatacagtaaaaagggattagagaaaaaaatcaatgaaactaaaagcagtttctttgagaaagtaagaaaattggtaaatctacagccagaataatcagtaaaaaagagtaggctcaaattactaatatcaagaatgaaaacagggatatcactacaaatcctaataatactaaagggataagtaggggatattataaacaactttatgccaggaaatttcttgaaacaaagacatggaaactgcaattctagttaaaacctttttcagaaagaaaatgtcaggccatggcaaaatctaccaaacatttaatgaggaaataccaccaattcttcacaaactcttgcaaaaaagatgaggggggaacatttcccaatttattttatgaagccagcattaccctgataacaaaactgacaaagaaagaaaactacagaccaatatctctcatgaacagagatgcaaaaatcctgaaaagattttagccaactgaattcagcaatatataaggatactacattacgactaggtgtggtttagctaggattgcaagattgcaatcttggattaacatttgaaaatcagttagcaaccttcgtggtattagcaggctgaaaaagaaaaatcatatgatcatctcaatagttgtgtaaaaagcatttgacgtaatttgctacccattcaagttaaaagcgttaaacaaattaggaaaagaagagcatctatgaaaaacctgcagttataatgcttaatggtgagagactcaatactttccccttaagacaggaaacacagcaagtatgtccacttcaacacatctattcaacattgtactaaaggtcctagccacaacaataagatgataaaaagaaattaaaagaatatagttttaaaagaaagaagtaaacctgtcattatctataggcaacatgatattccgtgtaggaaatcctaagtaatctaaaaaaaagctagtagatctagtaagtgaatttaacaaaattgaaggacacaaggtaaatttacaaaaattattgcatttctatatagtagctatcacaaattggaaacagaaatttaaaaatatgtatcatttactgcaactttcctataaatttataactattcaaaaattaaaagtttatgaaaaaatccaccatttacaatagcatcacaaatataaaacacttagggataaatgtaacaacatatatgcaaaacctatatactgaaacctacaaaacactggtaggactgtggggaagctaataaacaacagaaatttattcctcacagttccagaggctggaagttggagatcaggatgccagcatggctgggttctggcgagggctgccttctgggtggcagatggcagacttctcaatacccttcacatggtgaaaagagagtgagttagctctctggtctctttttataagggcactagttccaaccatgagggttccaccctcataacctaatcacctcccaaatgccccacctccaaataccatcacactggggactagagtcaacttgtgatttttaaagggacacattcagttcataactgccaagaaaaattaaagatctaaataaatggagacatatactgtgttcatagaacactcaatactgttaagatttacatcctctgtgtattagtttcctatgggtgctgtaacaaactaccacaaaattggtgacttaaaatggcacacatttattatcctgaggccagaggtccaaaaagggtttcactgggctaaaaccaagatgtcagcaggacctactccttctggagactctatgggagaatctattacttgtttttttccagtttccagagctgtattcccttggctcatggcccctttctctatcatcaaaaccagctgcataaaatcttcaaatctctgtctctgtttccaccacactgccttctcctcttaatattatctccctcttttaagggaacctgtgattgattgcatttattgccccacttggataaccccatcatctcaagatctttaacaggttccatggaagtgggtatctttgtgggtcatgatttagcctaccacacacaccaaattaaccaaattattttaaagaatcaatgcaatcccagcgaaaattgggagccagcaggttcttctgtagaaattgacatactgactttaaaagtcatatgacagtgcaaaggacctagaatgggcaaaacaattctgaaaaagaacaaagttggacaatttatactacatgctttcaaagcttactataaagctacagtaataaacacaatgtagtactggcataagaatagatatatagaacgtactagagagttggaaaacagacccatacatatagagtcagttaattttccacaaaggtgccaaaacaactcaatggagaaataattatgtttcaataaatggtggtacaactggataaatgaggaaagtacaccttgactcttaaccttataacatatacaaaaatttatgtgacatggatcatagacctaaatgtcatacacaaaactataaaatgtccaaaacacatatgaaaaaaaaatacttgcaacctacggttaggcaaacatttcttagatgggatatgaaattggacttctccaaaatgaaaaactcttactctccaaaagatacctatcattaacaaaatgacagccaagccacaaactgggagaccatactctgaaaacacgtatctgacaaagtaacctgtatccagtatataaaaaggacttttacaactaaaaaaataagtgaacaacccgatttaaaatggccaaaaaattcagagacatcccatcaaagaaggcatacaaaaagcaaataagcacacaaaaaatactcagtattttcagatgttaggacaatgcaaactaaaacgacaatgagataagattacacacacactagatctcttatatatgctggtgggaatgcaaaatagtacagccactttagaaaacattttggaagtttcttatacagttaagtgtatacttattctatggcccagcaatcccacacctaggtattttactcaagaaaaaggaaaacgtatgtccacacaaaggcctgtattcaaatattccaagaagctttattcataattgccactggtaacaactcacacatccataaactggtgaatggttaactgaattttgatatatccgttcaatggaatactaatcagcagtaaaaagtaacaaactatggatgacaacaacaacattgatgaatctaaaatgcactataagtaaaataattcagatggaaaacacaagatagtgtacaatgctacttatttgacattctggaaagggcaaaactctagacacagaaaaacagatcagtgcggttacagataaggaacagaaagctcagatgttaaataacttgtctaagagctcagagttgggagtcaaaccatttgactccaaaatccttctaattgagtattatactataccggctttacactgataaatgaacatgtttagaaaagcatctgtataaatatctgctgagcagctaacaggtctccactcgggaagattaaggatagtctttatactcttttgcttatgatatctgagttttctgtaaggtacgtgtactgtttttgtactatgaaaaataacataagaaacttcgattggaaaaaagggaggagggttgtaagaagactggacctacaaaattaaacttggaagcaagcctcccagagagaaaactacgctgggaagatcatgagattcagaggggttgctaaaaaaatatacatagcatcattgtgtcatggtattcttacccataaagttagggcaataatatgtacctcataaggtggctacgaatataagataatgagtataacaagtgctttgtataaagcactaaatcagtggctctcaaagtttttagtatcaaaaattttgacgtttaactcttaaaaagaactccttttcagttctaacacttactgaggatcccaaagagctctggttgatatgggttatccctattggtatttaatatttacgatacagttgttattcaaaaaatatctactcttcgaaggtaataataaacacattacatactaacataaataacattatttaaaaacatttccaaaaccaacacaaatttagtgagagtagcgacactgtttctacagtttagcaaaatttttaatgtatgatatcatagaagacacctagattctaatatctatatttacattcattctgttgcaatacattgttttggttcaagtatacaaagaaaatctggcctcacagagatctgtagttagaaaagaactattttaatagctctttcagataatggtagacgttcttcaacaggacactaaaactcaacaagtggtagtttcttaaaggttaactatgatgtggaatctgaaatcgtatcaatgacctttttgtactctgctacactgaaatccactggtctctcttatactttcaatgaatcttttatcccagcattattgtataatgcaatgtaggtcgactggaaaatattggtttactgagttataaagatctttcaaatgttgacacatttcatatacaatagcaaaaaaaatcacattacttactatcttcaccaacttcatcagaaatattttaattactgggaggttgtcaagctcatggtagcagatacaacttttcaaaaattctggttttcccatgaaagatcaaattttaccatttacaaaaaataccatgagttgttttccttgaagttttgcttcctgcactttctttttttgtgtgtgtgatagaagcatcttttattatagtatttttgtctttttttttcttttttttattattattatactttaagatttagggtacatgtgcacaatgtgcaggttagttacatatgtatacatgtgccatgctggtgtgctgcacccattaactcgtcacttagcattaggtatatctcctaatgctatccctccccccaacccccaccccacaacagtccccagagtgtgatgttccccttcctgtgtccatgtgttctcattgttcaattcccatctatgagtgagaacatgtggtgtttggttttttgtccttgcaatagtttactgagaatgatgatttccaatttcacccatgtccctacaaaggacatgaactcatcattttttatggctgtatagtattccatggtgtatatgtgccacattttcttgatccagtctatcattgttggacatttgggttggttccaaatctttgctattgtgaatagtgccagttagaatgtcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggactataaatcatgctgctataaagacacatgcacacgtatgtttattgtggcttcctgcattttcaagaaaatgtctgccaaacaccataacacaaataaccacagtcttgtctgtcagttgtccttccaaataaaaatgatactccatgaaaacagcagcttgtaactcaggcacacacgtttttccttgagtcaaccattgcacttcagcatacaacaggcctttatgcattcttcccatttcatcacatggaatattaaactagatgtgcattcaggggtcaagattaaatgagattaatatttttctgctttatcaaggacattcgtaagtgaagctggcattttttttttaactgcaagtccagcacgtggtggtgaagaatccagtgacagaagactagtgcagctggtgccactgtcctgatttgtgctccagcaccagctgtttgatgcactacttttgtaccaccagtgccaatgtcgaccaaggcaaagaatgtcttagtattataattttgactttgcagatacctggaaagggtctcaaggcccactcccaaggtctgtgggaaacagtctgataaccagcgtactcaatacacattagctaataatattaatactcgaaaacaaaaacaggcttttataagctgctacaaagaaagaacatttaaagaaaccaagataaaaatgacttcatcccttagactttggacaagaagagagcctgtgtcaaggtgattcacaagttaatagaaatggagttatcaccacaattacagtacacaattagtagaggcagaagttttctctcttaaagcagagggaaatattccaaaatctaaaaaaatcagaaccaatttgtcaactaaagcctgtggctacaaatataattaccagaaacaatggacttgaaaacagactatttaaaaaagaaattagtggattcaaacattaacaaatgctaagataatgacgacacaggattcatatgtaaattagataacatgtacaggtaatttttatcctaaaggattttcagactataaataaaaagtaaattggtgggggggggtggtaaatgctgtaagctaacttcattatcctctgtaaaacagtttccttatttaataaaaaaagagagtagtggaactaaagaaaagagaagtaccaaaatgttttaaatgttggaaaagggattattttatgtggtttttgacataatttaaaggaaacttaaaattttatgtctattacatgaaaaatagaaaacaagataaacttacaaaaggacccacaaaatataattcatgattcaaatactagggttagaaaaatatacatgagctgaatgttctcttattaatttcctattgctgccattcaaaactgccacaaacctagtggtttaaaaagcataaacctagtggtttaaaaggcataacccttacaattctggaggtcagagtccaatatgggtctcgctgggctaaacttgaggtgtcagcaggactatgctactgaaggctctaggagagaatgtttctttgccttttctagctctagaggctgccacattccttagctcatggccccttcctccatcttcaaagtcaacaatggagaatgcagttcttctcatactgaatcactctgacctccttttctgtctccctcttctatatttaagggccctgtaattacattgggctcagccagagaatccagaataatctattttaaggtcagctgatgagcaaacttaattccatctgctaccttaattcccctttgccatgtaacagaacatattccctggttccacggattaggatgtggacatacttgggggcgtcattattctgcctaccacagctctgtaaaaagaaaggttgcttcctagattaagaaagtaaacctgttacattcaagagttacgcttggaaccaaagtcaaaagtcgaaccaactatcagaaatcagatgacagaggtttagcacgcctggatgaagacaagagcaacaatttactatctttaaaattagataaattagatttcaaagccgaaagtattaaaatgctaaaaggactaataaggaaaacctaaataacaaaaacctaacatgaccatggaatatggaaataattttacaatttttcttttttaaggatacacagaaatattttaattgtgggcttcctcatgctactcttaaatcatgacagataaaacagacaaagttcctaaggaaaatacggaaatgaacacaagagtagatttaaaaaacagcaaggttatatgaagagaattaagtagcagaacgagaaaatttaaaaaacagcaagcttatatgaagataattacgtagcagaacaagaaaacatacttgctttacatatatatagtttttccagggagaaaaaaaggatcatggggcagcaatacacaataaacacacatctaatttacaattgttaaaaatatttgagtgcctgaaatgtgtgagatacataaaaaggagcaacaatgcgttcgctcaagatgctcagactaataggaacagagggagatgatgtatcaacaagtaactacatatggtaaactaggggacttggaagattaatttccctgagagagatgggaagagaagtggaatctgggcaacaagttgggaataaggaattccagacaaagggaataagatgttttccaattttttaaaaattatttttatttattatggatacaaaacagttgtgcctatttatggggtacacgtgatactgtgatgcaagcatacaatgtgtaatgatcaaatcagagtaactgggatatccatcacctcaagcactgatcacttacttgtgttaggcacatttcaattccactcttttagttatttgcaaatatacattattaactatatttgccctcttgtgctaccaaacactagatttattatttctatctaactgtattattgtacccattgctcatcccctctttatcctcccctctccaattccagcagactggaacacacagaatactttctataaatcgtggtgggtagggtgctgcagagacaggagaaagggtactggggggaataagccagaagttggctgtggtaacatggtaggggaatgtgaatatcaaggtaaagtccttggaatttattaataggtaatatggggccactgcagattttctcaacaagagtgacagaagatacatatgagtgtgtaaggtagattgtaatcagtagagaccagaggtagacattttatacaattcataaaaacactgacaaaaaatggatcattttcaatactgatttgttaagcagtttagtagagttactaaaatacaattgaaacataaaaatacctgggcagctgccaaaacaaaactcaagagaaaatgtgttcatttaaaatgtttaagtaaaagtagaaaacaaagaaaaaaaaaaagaggcaaaagaaaactagtaaactgagtttctaagaaatttggggaaaaagccaaaacatgaaaataataaaactaaaagtagaaatatagatataaaaatgaaactgatcagtaatcccaacagctagctttttaaaaaaattaaactacaaagttgatcaagtaaaacaaagtaatacaatcagtaagttcaaaagatgtaattcatacacactcctagttggggaaagaaagaatagtatcttaactatatcaatatatttgcaagcaaagtctaaaaggtgactgcatagccaaaaggaaatatcaagcctgatttgcaaaagaatacacaataatatgcaataatacagtgataagaaaatgtatttacaaaaataacttatggtcatagcctaaactactttgagttacttttcaagaaacattcagaccagattccaagtataaaaatagactgcttaattctccacaaacctgggagaaatgggaggttctggtttaacattaatcactacttcttaaaattcacttttccagttacacctttagaatggatttattccactctcatttgaatctgtagtgttagtatacgatgaatcactaagtagtgctacctgggccaaagctagtatcctctctgaaatttacatggagctttctgctcaggctcaaattccctctctccactttgcagggttgggagaatagggagggagaaaaggaagaagggagggagagagagaatatacttagcaaaggaatgatgactctgaatgtaaaagttctagtatctgttttctgcatatcataagaatgcagctggactctttttagacctatcagtttttttccagtggaagctgctggcttcactggagcacatacacgcgcattaacacatgcctgcatgcacgtacacacgcacaagcacatacacacacacaaactttggatggcacatcccagtctaaagcttgacagaatggctccaaatgacaacctgacatactcacaaactatcaagggaactgcccctcttacaccttattaaccaaatttaaagtcttttagtggagactttagctggttttattaagataaaaaatgtttaagagcatttaaccagtagatacaaaaaagcacaaaagccaaataaaagcagagcccaggccagtaggaagatctgcatttaagttcctcaactgccattcatcagcggtgtggtcttgggtgagttattttcccccaggtctgtctcctcatctgattcctcatatactgattcattaagacaagggtatgtgaaagcactgtgtaaatgatacattttacccattctagctttagcagtattatgaaagacaaaagttctgccacattgtaggtaataatctcatttagcaatcattgttgtcactattaggttggagctgacaaagtatgagtctccacttataaagcatctatctccagagttcgaggcttttgtcttaaattccagtcatcttgtacaggcatgacatatcaggcaaaatgattagaaaactcaagctccatattaaaaagcttaacttctggagtcctaggaaactatctaaaactccttcaatccacggtctctcctgtacaacaaagacttcccagtggtagatgtctatttgtacccaacatccactcattcagcacgtaattcagcacctccaaatcctggccctcaaagaacacagctaagaacaatgtgtgtgtaattatcaagtaataggaatgatacttttaaaactggaaattatacattcaaatgagatttctctcctttaaccagtccccttgggaggcaatgcagtaattccaatggtacttcattactcaaatcatctttgaagctttcttcttggaagcaccttgagaacctgcagtctgatcttctgactatcccaaatggtgctaaattttcactgagggtggattcaaattttggaaatggcaaacagtcagtcagagccaaggttagtgaataagatgtgtgatcaaactaggtggaactattttggttgaaaatgatagatgatcataaagcaatgagatggatcttcttatgtgatatgtaaactgactttaaagggaattccagatgagtaacaaggagtatgaacaatggaataggtgtatacattctctttccccaagtaacctctttgaataacaacactcatttggatgtataagcgccactaacaggtttgttttgtttaatcacttacaatttgtaaatagagggttccttagcatactggatctacaatgtcatggaggaaaggagttgtcacttaactagaactatggcatggcacgcaggaaagagcacaggcttcatgagactgacgtggattcgaatgttgacttagattcttcctgcctatgcaacttcagggaagtcacaagctgtcaagactttaaaataaggctgatacctaattttgcagggttgttgtaaagatcatggataatggatgcaaagcccctacattgggcctggcatgtggtgggtactcaagaagtcacagctattattaacagcaacatcagtaaaatcaagaccattttctgactgtaggtggcttgagaggacagaacaacagataagcagtcacttgagtggtaagtagttcattgacagtactgacagtacactcgtgcattagatactgctttcttaaaaacaataacctgtaaaaactatttgcagtaactatgtatttttaattcatacgacacatatcatctgcagtgctcataccacatggacctcttcactacctgaacataccaggcactatcatgaccccatgcctttgtgtactttgtcccttctgagatactgaaaggggccagcccctccacacctgtgggtatttctcgtcaggtgggacgagactgagaaaagaaataagacacagaaacaaagtatagagaaagaacagtgggcccaggggaccggcactcagcatacggaggacccgcaccagcgctagcctctgagttacctcagtatttactgatcattatttttactatcttagcgaggggagtgtagcagggcaacaggtggggagaaggtcagcagggaaacgtgagcaaaggaatctgtatcatgaataagttcaaggaaaggtactgtgcctggatgtgcacgcaggctagatttatgtttctctttacccaaacaactcagtgtagcaaagagtaacagagcagtattgctgccagcatacttcgcctccagccacagggtggttttctcctatctcagaatagaacgaatgggaatggtcagctttacacagagacattccattcccagggatgagcaggagacagaagccttcctcttatctcaactgcaaagaggccccgctctttcactactcctcctcagcacagacactttacgggtgtcgggctggggggtggtaaggtctttcctttcccacaaggccatatctcaggctgtctcagtggggggaaaccttggacaatacccaggctttcttgggcagatgtccctgcggccttccgcagtgcactgtgtccctggttaatcgagaatggagaatggcgatgacttttaccaagcatactgcctgcaaacatattgttaacaaggtacatcctgcacagccctaaatccattaaaccttgattcattacagcacaggtttctgtgagcacagggttgggactaaagttacaggttaacagcatctcaaagcagaaacaatttttcttagtacagatcaaaatggagtttcttatgtcttccttttctacatagacacagtaacaatctgatctctctctctcttcctcacaaggtacccttcctactctctggtctgatgacaaccctacaattctagctcaaaagtctggctcaaaagactagctcaattcaaaatctagctcaaaagtcatttccactatagactcttccctgcctgctcgagacagaattagtagctctgccatttgtacttctaagacatttggtttctttcactgtaatgcctcatactctattgaattcttatttccctttcatttctgcttcttccactaggcttacgcattgagaggaggactatattcctttatttttgtacttagagcacctagtacatcacttggcacgagataggaatctagatgtttgaggaatcaatgttataatatactttgcaaataactgttagaggccaggtagctgactttagtgaactatattaccagcaatcgcattcctttttcctgcttcaaacaagagacaagataacttatatggactccagaatgtcttctgaagatggagcatacagaagtctccaaacactactgatctcatcagtaccccatgcccacaagttggaacccccagagcaacacttctcagcctttgttccagtctagcacacctgagggatacaccacactcccatcaggagctcacaacagatgactaagaaggcccagcagagttttcacagccttccagtgccacatggctaccagggtggaagggccttctctgaaccagcaactcccccaaagtagcagaaaatttcaaggctccatggtgagtgccgggagcccacctaatgctacctactaccagatccctaccacctacaatgcctcagaatcagtttgcctactctaagaacagggctctttcactgttaggaagcctcaggcattcaaggaaggacttgtttgtgggtccggtacatctgtttcggcatgtcttaacctgcataactaaaaagcaattatgaaaagaagttcatgatcaaccagttcagtgccagatggaaataggtagagtgggtcagctggcagccctgtacatctgagtgttgacacttgtgaatcattctctgtcactatagtttccagagccttgccaacgcagcagtgggttcagacttaccaagatccaaaaggctggaaaggggatctggagccatgacccatgccttgggacccaccaaaccatgacagtgactatttctatgacaaagacatgctcttcaaagtaaatatagccatattctgccttagtgccatgttctctcccatctctccaaagcaatggctgcactctgaaggtgggaagagtgtgagaagaaagagaaccaggccacagaccaccaggaaagcagtgattgaaagcagcagctctagatttatcttataggctctggagagttattcagttatttactccacaaatatttattgagccaggtactattccaagtatgcaggctacgatactgacacagtcacggccttgaccccatggagcttaaagtttagtgggggaggcaggtattaatcaaataagcatccagacagacacaagggtacaaatatgcactatgatggaggagtagtaaatactacaggaactgtagaaacagggagcagtaaatctggtcagggaagtcaggaatgcttcccttagcaagtgccaagtgaggataaataggagttcactaggtctggaggagaggaaaagagagggaaacattcctggtaaagagaacagtgtgtgacaaggtcctggggtaggagggagatgttgaattggttcaaaaatagaggcagggagcaaagcagtagcatcaaggtttgagtccccagcataaggtaacttcctgtgtacacccctcagttttctttctcctatagagaaggccttcctcagcatggaaggagactaaagcacactgtcaaaaactaggagtgctcaggagaggtgaaacactaccagctaaaaaaacaaatctgatttaccaataatacctggccaatgtcctcttgaaatatctgtaaaattaaggaactcactacctctggcaacaatgaatcaggaaaatggcacagtataaaagacctttaaacttttcaggtagaaatacattttaatgcaggtagaattaagagattgatgaatatgttgagaattactataaatctgcttagataccaggtatttcactgtaatttcatatactaatttttttggggggaaaagggctaaaggaaaaaacggttaaaggtagtatcagtgcagcactattttgctttggcaactccgttagcctgtttgatcacttaaggcagtttcttgaggcttctgaattctctgtcaccttgcaaacaagtcactgtagctttctatttgtaaggcactttgtaatcaatccttaattggcctccctaccccactgagagattatactcattctacagataaaacaatagataagtgagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagggcacatacaaagtcacaatgactcacaagttaaaatgtcaccatccctagggagactgcaccctcaacatacaaatactcccctaaaacttcctttcatcctcaacaagcagccaaggcataggtccccagagttggcccccgcagtacagcactgcacagtactgtaaggcatcttaagtgtacaagcccttcttcaccccatgctgagaccgccagcatctaaagcacctaacataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcctcatttttctaacccagttcagagcctccttggatcctgtctaaactttgtggtcacttcacacctgacctctgcctccactccaggctgccctacttacaagtaccaggttcatcttccttgggcaagtcaacatctttgagtctcagtttttctcctccgcagaatggaaatgataaaaacctcttttctaagcgtgttaggaagattcagtgagatcgtgtgcataacacactgcctggtacatgctaggtgtacaaagaatgctgttgctatctggtactctttcaggtgtcaacctcctcaaggattttgtttgcttttggaatccaagagcaggacaagctcatagcaggtgacctagtttaccatcttcactttgggcagatttaagttttcatgagcacaacaatgccttaaacattagtctactatcattatggataatagtcatcctttgttgcaatagcagagtttcacaaatgacaattttatactgtttagccccaagggcagcttgagagaatcacaattgcgatagtcatacttagtcttgatgtatcacctttcttctgagaacgtaaaaacatatcataagtggtaattaagcttcccaacacccactgggaaatggatattattatatgagctgattttaaggttgagtaatccaaatcaagttttcatctgctgaagcaccaggaccctgtcccagactttttcacccatcttcctttcccatcctctgggtaaagtccaatgtgtagcccagaggaggttctcaatgaacactcaaatacagacgaggaattaaggcgcagagaagcttgtataacaggccctgagcgagccagcaagtaagggtgaaggagcacagatgaaactcagggtctagctgaacctgcagcccatactgttagaaagaggtgcttgccagtggtcagattggacagcaccatcttcattaccagtgaccgtgccccaagcaggcatgagaagatggtctgccagttcagacacttgaataacaggcatcactgccctttcaagagcttcatagatagagaccaggcaggctcctcagagtccagaatcttgagggcagacgctactttaatgagatcccagggagtctgggagctgaaccactgctctgcaggcccacaagttcaattttagcagttcttccagagttgaccaggccctggaagctatctagcaaaggcaacaggacactgatgcacaaattacttgtcagtgtgttcttttgctctgacaaggtaaattgccaagaggaacatatgaacctgtctgtgaggaaatacaggaagaactggactttcccaaggcttcacatccccagtcttcaagaggtggattacctggactgattctggaagcccaaccctttatgctactggtgctctcatggggaaaaaaaagccagaaaccagatggccatctggtcctctctccagcaagtgcaaaagaccctactgacaacctgctgctcacttcagagccctcactcagtgtcccaccctagatggaggtccaaagcctcaatgacctgtgtagacagacccacaagtgatcctgacattaaagaaagaccctgggtcatatgcaggcaccaggagtgctgggaagcttaattaccacttattaaatgtttctacattctcagaagaaaggtgatacatcaaggctaagtatgactagtggagaagatgacacccacatcttctccactagcagagtttgactttatcttttccttgacttgccaaaaaattccagggctatcttgctaggggctcccaacattcttcactcaaaggaaagaaatggctctggattgaaaaagtatgacccccaaataagccagacagcatattcttgtgactttggggtgggcttaggttacagtgttccagaagaatcagtgtatatctgaccatggttttaaggactaacttggatttgtaccacccttctgataagctggtggcttgtccaattcaatattcacattggcttcaatgtggtgatataggatgcctctcctctgaagagcaaggcactggtgaagagaatcctggtgaatttagacacttggactggggagacctggcataggggaagaaaatggccgtggaaccgccctccacacaccaccaaggctccttccctggctgcagcagtagaatggagagagtgtggaattagtagatttgaactcaacaccagtttcacccttgctccagtggagggagggccagctgggatccagtcccgtgcaaggcctatgggactataaagagcttctcggaggtcagattgacaagttctttagccaggaaacatggaggtgccagcctgcaaggctttcttagcctggaattcctcaccctaggttccctaaagtccacactttgaatgccaccaattagagaattgctgaagatgctgggaattagtccacctgcagaatgcaatctcctgcttcctgacagaaccctttgtttcaggcaactttagcctaacttggatacacatctgagatctccctgggaggtgggtgggtctggagtctagacagggatttgattaaatacggggctagatttaggggcttggagaactggaggaggagattgcagggaggcaactgaagggaccacagaggtagtagctgtagttctgcttggacttgcagcaacccctatggccttccagagcccagaaggagccacctcctcagggagtcttccctcaggtaggcaaattacagttactgagagagaagagggagggaggacagtcccaaggccccagtggacctcctgtcacccagggtagccctgggagtgggtggtttatcatccctcatggagcaagctttctgctaaaggaagcaggggccatttcctgttggaaggcagaatggggagcctttgcctgggccagcaaaccaccacggtatccctgtgcttctcctctggacctctcctgatgccagggtttccaggaagccttcccggctgtgccacactcctccagtgtgctgtgtatgcaaagcccaggtcaagtgtgtgtggccaagcacacggggcagacaaaaaggcccatgcttgccaaaggtcaccaaccagctgcccacatgattcctttttctccttgttcccaacctgctctcattcctgaatctccactcaatgcttgtctttctccctttctgtttccacactgtatttctgacacattcctctggggccctctgccctaactaatcaaatgtgctcttcctcatcttgccttcccctaatggatcctttcatcttgggtagcctgtaaccttcactcctttagttgcattcatctgacatatgtcttccagagtgtctgctttgtgccgggcactgtggaaggcactgggaacacacagatatgaataatgaaaacacagcattgtgcacgataagcattggggatgagggaaccgctgagctgaaaaaataacattgtaaggtaggaagagaggaaatgaggttccaggcagagtaaacaacagttgtaaaaacacagaagtcagtgaatggaggcaggtgcaccattttggagaacaatattgtctgcaaccatcctcccttcccttcccaccaccccactctgcctacaggcagctgtgcgtgtgctctcagctctctgtgcttggaggagtcagttttggagtcccatgatgcttcccactatgcccctgtattcttggatcctggcatgcagtaggtgctcaggcaatggtcatgaaatgaatgctgatgttggacagtcacagggcacaaacaaaaaagcagttcttcctcatcccttgcctcaaaccaggcaacttgtgtctgcaggaaaaatgaccctttctttccaagtttctaatagctgcagacattatgtgggtacccacactcccactttcctacaaatcattgacatgttgaggttttttgtgtcttattataaaacaacttataccatgcttgtacagttctaagatgtgagatgaaccatctatttaataacagattttcaagggtaaaaccctgcatgaatcaatgtacttatgcatcttaagatctgtactctttcagaaatattaccatgtacaggagaaggtgcatcttagatgttcagcagtaattgctcctttttattcatcataagaaggcctactttgggccatcttataatcgtcgttatgagttgaattgtaccctccaaaatatacccttcaatatgctgaagtcctaatccccaatacctgtgaaggtgacctcactggtaatagggactttgcagctgtaataaagttaaaatgaggtcattggagtgagcccttaatccaatatgactaatgtccttgtaagaaaagagaaaatgaaacacagacccagagagaagacagccatgtgaaactgaaggcagagactggagtgatgctgccacaagccaaggaacacctggggctaccagaagctggaataggcaaggaaagatcttcgcctagagccttcagagggagcacaaccctgccaacaccttgatattaggcactgaacctccagaactgagagagaattaattggtactgttttataccgcacactttgtggtataacacttcggtatggcagtcccaggaaactagcgcaatcttacaccaatgctccgaagttgtgctatgttttggtttggctgtgtccccacccaaatctcatcttgaattgtagttccccatatccccacctgtcatgggagggacctagtgagagttaattgaatcatgggggcaggtaccgtcatgctgttcttgggatattgagtaaattctcacaagatctgatggttttataagaggccttttccctttttgctcagcttttcttcttgctgctgccatgtgaagaaggacatgtttgcttccccttctgccatgattataagtttcctgaggcctccccagccctgcagaactgtgagtcaattaaacctcttttctttataaattacccagtctccggtatttcttcatatcagcatgagaatggactaatacaccccgtttttcagatgaggaaactggcagatcactaggggtcaagcatagaaaaggtgcagccagaagaactaatcttttatagtctgtatgagtcagggttctctagagggacagaactaataggatagatatatgtatatatatttaaagatgagtttaagtattaactcacacaatcacagggtcccacaataggctgtctgcaagctgaggagcaaggagaccccattgaagctccaaaactgaagcacttggagaccgatgttcaagggcaggaagcatccagcacaagagaaagatgtaggctgggaggctatgccagtctagtcttttcacgtttttctgcctggtttatattctagccatgctggtagctgattagatggttctcacccagattaagggtgggtctgcctttcctagcccactgactcaaatgttaatctcctttggcaacaccttcacagacacacccaggatcaatactttgcatccttcaattcaatcaagttgacactcagtattaaccatcacagagtcttacccaaaccactcggaggtggcttccagttcattatgggggcataagtgtgtcctcagagacataattcctcttctggctgctttctgggaggaaatgtagaaaaggaaattggaaatattattggcacaagagaggtttgcagttgacaagtaggtaaacccaggctgattcaaaccttgaaaatgattgtgtgagcaacgatagtttttttaaaaatatcaatagttttaggggtatagttggtttttgattacatggataaattctttagaggtgatttctgagattttggtgcatcacctgagcagggtatgttgtacccaatatgtagtctttcatccctcacccctgcccacccttccccctgagtgcccaaagtccattacatcattcttatgcctttgcatcctcttagcttagatctcacttataagtgagaacatacgatgtttggttttccattcatatgttacttcatttagaataacggcctcgagctccatccaagttgctgcaagggccattatttcattctgctttatggctgagtagtatttcatggtgtatatctaccacattttctttattcacttgttggttggcggacatttaggttggatccatatttttgcaactgtgtattgtgctgttataaacatgcgtgtgcatgtgtctttttcatataatgacttcttttcctctgggtagatacccagtagtgggtttgttggatcaaatggtagttatacttttagttctttaaggaatctccatactgttttctgtagttgtactagtttacattcccaccagcagtgtaaaagtgttccctttttaccacattcatgccaacatctatttttttttatttttaaattatggccattcttgcaggagtaaggtggtgtctcattgtggtttaaatttgcatttcctagacaattagtaagaatgttttttaaataatcatgtggagggccaacctgcaagtacaagctgtgacagaggtaatttggaatgtggctccagcattcctcaaaaccatgaacttgggaggccaggagaatgcagtgtggaaccttttctttggcattcagggtgtccagccagaggactctccctcacaaagctttggggtgttgggttgaatgcaaggagggtgggcctggaagatgtcttggaagccttcttcagggtcaacacccacagatccatatattgatcctggccccagttcagtgaccctgacttttgccccagccagggctagaacaagttataccatatctgcacagttccgagatgtgagatgaactacccacaacaacagattttcaggagaggaagaaatgtaccaatcaatgcccatgtagactctaagacaaatattggtacagaaacattaaaaacaataaatggaggcatttaaaacaaatatacatggataggaagattcagtattgtcaagatgtcagtttttcctaacttgatctatatatttaacaaaatcccaattaaaatccagcaatttattgtgttgatgtcaacaaagggaagggctggcaagagccaggcaggaggtcagctccttgccaagggggctggagttcagagtagggggttagccatggctggtggaacagggaggtttcccagggaagtgagaccatgtctgtgaggcctcccacccgcccctcagggggcaggctcaggacatctggaaaccctcaagacctatccacggatgggcacagggaggctcctatctgctccgccctgacatggtcaagattggctctgtcctgtgtgatgtgtgcccacactagaggctgctgtggaggatgctggaccctgtaaatgcctccaggggaggctgtgggggtgtgtggaacatcctagctgctccagccctgcagtccttaggaaacacagggtgagcactctccacacaccttggctctaagaagggacatgcagtatccctgtttccagcagtgtccttccttccattctggagtgccacacaggcatctgtgtctggccattcccaggagtacctggctcataacatggtccagcctcattctgctcccatgtccctctccccacagccagcccagggcagtacagctggatttggcaggtgctcctcctcactcatctcctggggtggctgttcctcagcatggaccccaaagccctctcacaccaagctcctttcgaaatcctaatgtgggtctaagtgtattctgggaactgaggagtgttgcgatgttcaccgcccccaccatctgctacagcctttagtcttctttaactgcctctctgggcatactgaggccctagctgcctctgctaggacaccccagccccacctctctggatcaacctcagaaagcaaaacctcattgtcgcccatttaaggtaatcagttaatcaaaagccaggcattacatgggggattatttgaatagtacctcctaatcatagtaatttgtcactcatcacactgcaatgattattatttaccaaccactaggagactcgccaaaaacttcatcatctcctgccagttctaccacaatatcttggaaggggattccttactggggaatttcaaatgatgatatttgcgtgttaacataatcatcagatcctgtcttgggcccagtggttgttagtagagataagaacggtaaagctgtaaacagggccaactgaggccaagtattggggactatgggcaaatttgggcacagcaacgagagaaggaaacccctggtctcaactgagattttggctattttggccactgccttccacccatactgaggaggacaacaccactttcggaagcctgaaggttgcaggtcacatgaaaaacttcctgtagtcagcatcctatggggtgattcctacccagggccttaaatgcacagaatctggtttctcacatctaaaggagcaaatgtgtatgacaactcctaggtgtagagtgatctgtgttctgtgttgttatggtttgagaattaatgtattgcttctgcagcaccttcaatagaaatgactgtgacaaaataatgtgtctgcttctatttcagtggcaaagagtaatcacatgacccttcctaacttcaaaaggactgtgatgttcccctgtgttcaggaaggaaaggaggacaagacatagatgagcacttgtagtatctcccataaactgttttgcagatgtccaacataaagcaactacaattaatccttgaacaacatgggagttaggggcactgaccctccatgcagtcaaaaatccacctataacttttgcctcccccaaaacttaactaataagctattgtcgactggaagccttattgatgatgtaaacagttgattaacagatatttttgtgtattatgtgtataatatgctgtattctaacaataaactataaaaaaaattaagaaaatcataaggaggagaaaatatatttactattcattaagtggaagtaaatcatcatgaagatatgcgtcattatcatcttcacattgagtaggctgaggaaaaggaagaggaggggttagtcttgctgtctcagggctggcagaggaggaagaggtaggaggggaagcaggagaggcaggcatactcagtgtaattgaatgaaaatacgttgtaattttctttttcttatatctaaaagtttctatatggtaccaatccttcttccactgtttgttttagtttcagtgcccacatcatagaagggtccatgtcgtaaaaggagtcaaaagcagtcttaaaaaattggaactcttctgccagattgtctagtgttagttttttttcctggcaccgtttcttatacatctttttcctcatgatctgtcactggtttggaaacactcatctccatcaagtcaccttctgttatttcctctggcatggtgtctattagctcttgaattttttcaagattcatatcttgaaatcttttacattccatcttttggaccatatccacaacctctttcattgtttccttatttgtctctgtcgtaaatcctgtgaagtcatgcacaacatctggacataattttctccagcagaaatttattgtttaaagtttgatggctttcacagattttctataacaataatggcaccttcaatggtaaaatccttccagactttcataattttctctctatggggtttctcttccatagcgttgacaatcctttccatagagtaccatgtgtagtgagccttagaagtccttatcctgatttagaggctgaattagagaccttgtgtttggggataacttcgatcatttcagcaccctcaatgttgaactcattgggttctgggtggccagggacattgtctaatagcaaaagaactttaaaaggcagtcacttactgccaaggtacctcctgtctccagggacaaagcatcgatagaaccaatccagaataagtgttctaattgtccaggctttcttgttgtacaacccaaagactagaagctgatattttatctttccctttcaaggtttgagggttagcagctttatagataaggacagtcctgatcacaaacttgactgcatttgcataaaacaatagagttagcctattgctttgtgccttaaatcctggtgcttccttctcttcctcactaattaatgtcctttgtggcatttttcccccggagtagggtattttcatctgcattaaaaacctgtacaggcagatatgttttcttctcaataattttcttaatgacgtctgggaacttgtctgctacctcttggttagtagaagctgcttttcctgttatcttgacatttttcaagccaaatctctttctaagattatcaaaccactgcctctatcccagtgggtatatatatatggatatatatatatatatatatatatatatatatatacctgtgctttgcccaaacttgcccatactccccaatatctggcctcagttggcccagtttatatataatgtgtatacatatatatatttcattttattatgtatatatttaaatatatatgtatatacataataaaattattgaaccatcctttgctggcattatattctccagctttatattctacacggatcttttgcgttaagttatcatataataacttggatttttctggattcatattagaatctataggtatgcctttcttgtggcaattctgcaccacataaaggctgcatttgccatatgggataaaaaggtgtttcacaaaatgtgcaaggttttcacacctgctgatgtagttgcagaaacagcttcatgaatttctttttctttttcttttttcttttgtttttacaatggttcttatgcagatttcattaatcttgaaacagtgggcaactacagctgcaaatccaatctacggtacatgttaagcaattcaacttttcttataatgttatttcttttctctgcttcttggcaggaattccagcatcactagtggcacattgtatagatccaatggtgttattcaagttttaaagtattggactaaacatgatggaaaatacgtgagaaccatgagagatcactttttactgctatacgcaatttactggagagacaaactcctcacatggagataattagcgtcccatggcttttcaagcagatagaagaacacttgagcttactgcaatagcaacaggaggtggctatgaaattattacagtagcacagcttatgctacagttaattttatgcagttatgatttaatactacatctcaacatttgtttacatttatcttgactgtgaataataccatgtacggtctgtaactttttgtgtacataaattttgataaaaccttttacaatagacttcatatattttatagtactaaataacaaaatatcctagtatccacatatattttattcattcatgacataactctttttttatatctctaggctatgcagtttgtgagttttttcaaattgttgcaaactccaaaaaaatttccaatatatttatttaaaaagtctgtgtataagtgaacccacatagttcaaacccatgttgttcaaaggtcaactgtattataatttattactacagcaatcctcttcatttctgggaggaatttctgaaaaggtcagatttgcttcaaaattccccagctttttcaagtacctacttattatatgacagatgcttcaaatacaggatcacatctacttttcaaataattctagaaatctcatcagggaaggttcaccttcttcactcaatggcacatttctgcacttccctttgcaataacctctaatctcagtaggttgagatttttaccctatttgattcatggtcaaaattttaacttgtgagtctttgttactgtccacataactgaacttacctgaagacttgtgcaagtgccattaggcactttgcaaacaaggattttcctgtggagaggcacacagacaagagatagcagaaatatagtttttttttttctttttaaatcagagctagcatgtccaaagaggaagcgtttttcacctccttggagggctccagggtttttagaaattctgcttcagtagatttttttttcctacagtggtttacatggtctttctgcatctacaagctttgatgtttgaccacctaggtaagcttattaacctgtgtgtattcagtggaaagtctaataagacattttattaaaatcctactcctatatctagatgctttcaaaaaccctttatctaactttacatttcagtaacaagaaggaatacgttgtgtgccaaatcagagcctgcacccatttggaaaagtttcagagtgtattttgactctcaggcatataaccaggcatctgaacatcactgtccaagtgaacttttatgtcaaagaggctgttgccattagaggagttccagggtgagcaatgtgacagccaaaggacgttttcaggaagcaggcatgctctatgtcagggggaaggcaggtgattctgggccattccactgggagcaaggcacagttttcagatgatcattttcacatgcttactttaggtcagcttttagtgccttgacctcagcattcttctttttgtcaccttagagacattctgcaatacttactacaaaaatgaattacaagtcagaagatagacctcaagctggggagaatgggaatagcgtggtctctagatgaatcaggccagggatctggtgccaatctgtcacttactaactatgtgatcctgggaaattactaagcccagtgagcctcagtttctttatctgtaacatgtgtttggtactttttataatagactattagaatataagacatttattaaaacacttggcacagtgcctgacatacattgcatctttaataactatcatttatttcttttttttttttgagacagagtttcactcttgttgcccaggctggagtgcaatggcatgatctcggctcaccgcaacctccgcctcccaggttcaagcaattctcctgcctcagcctcccgagtagctgggattacaggcatgcaccaccacgcctggctaattttgtatttttagtagagacagggtttctccatgttgaggctggtctcgaactcctgacctcaggtgatccacccacctcagcctcccaaagtgctgggattacaggtgtgagccaccgtgcccagcccaactatcatttatttctaacattattttgaccccagattttggaaaatatttttgttttccaggacatctcagagaatttgcagttgaatgggaaacagaattatcactaaaaaatgctgcttagtaaatgtcccttgaagaggattcattatttaattaggtgttggggagtcttccatagctgagtgcaactcactaactttaagatcctagaatttgggtcacaaactcctttcttccctcccagcttctgtttcaaccaaaccactatttttcattcacctcattcatatcatccccaccaaaagtatagccatttcagtggagtcagctgtacaccaaaccaggcagaagagtacctggccagtggcttctggcctcccttcctgagagattcatgcttatctcaggaaattcttgcagatggcagatgttgggtatcagtcagccacctcttacactgtgttcgactacactgggacaaaagtgcaggacaccttccattcctgcccctggtggagactcctctctgctacatccaccacccaaaaggaacttctcagagcagtttttcattccaggcttttctctaaccctctaagactcatggtctgagattgtggcgcttgtcagcttcattataatcaactcctcaagaaggaactgcggtttcccaaagatcaaaacgcccagctcagggcatttaacttcaccactctcacctggagccccacaccctcacccctctcttacttttcctctgcatcttagaggacatctcgccaccttaattacatgaatgcaactcctagactctactactctaagggtaggggtttctctggcttattctagtaactccactactaacccagagccttccaaagaggagatgctcataaaagttgtggaaagaaagactcagtgagcaggtcttttgtttaagttgtaatttctcctacaaccttcaaaaagcgaagcaaatccagttatatgtatatgtttcaatttttatagaacaacagatgaaaatggataaaaaggctagaattagcagacttttccttttattttatggccccatcaatcttattgataatttcttacatttgccaagaaaatatctattccaatgccatggtatattgttataagtcacaaagcaatatggaaggtttcccagtatgtctcactgaaggcagcagtggccagtctggagtggatgctaccatcatatgaactacaacagggaggtgcagccagggctgcacactccttggaaccagcatgaggcagggacaagtgggagccctgccccttccgagttggtggggtgggagctccccgggtgcagccacagccacccaagtcgcagctttggatacaggcctcccgcttcatggagcagacaggagcctcactcccctgggtgcagctgcagctacccaagtcgcagctttggatacaggcctcccgcttcatggagcagacaggagcctcactcccctgggtgcagctgcagccacccaaaccatcgctgcagacccaggcatcctgctgcatggagcaggcagaagccccgcccccctcccctgggcacagctgcaaccgcccaaaccatcactgcagattctggcatacctgccctcttgggggcccaggaaggcccccaccaccctggcagggtcagaaatgcctgctcctactcctggcttctccctgctatcagcaaccactccagactcagagcaaagttgggccaagcccaggtgctgccacagcctggctgggtgtgcacacactcagggcagtgctgacatgtcagtcccctgctggcttggacccctacggaatttgggcgccaatgagcatagtagggaagctgatggggtggtgagggcagctcataactggcctgtaggcatcccttggcacctatggcctgggctctgtgaatgacagcaggaggcagacaggttcctggtcagaaggcggcgagtccctggtgaggccccaccttcaggccggggagggcctgaagtctgggggctgggctgccagtcctgtggaccagagtgggaacttgtggtgccttttctgggcccacccatggccaccgatggaccaattggcatgcactttctcccttctgaggcccaaaaatccccaggctcagccagaagtgagcagatgtcgggacaaccagcttcagagaggagctatccactccagggcctcccctctgctggaagctgcagagatgggaggacctgcctgcagagagaagcttcccactccagggtctcctctctgctaggagctgaacacttgttgggacaccctgcctgcaggaaggagctgaccccctgcaggagactaagctgttctattgctaattaaagctcctcttcatcttgctcaccctccatttgtctgtgtacctcattcttcctggtcacaggacaagaacttggaacccattgaatagctgagctaatagagctgtaacacaaacagactgaaatatgccccttgctcaccatgttgcgagcaaagagaaggagataagacctgtggcccatccgggagcccagacctgggagctccctgagccagggctgtgactccctctttggggccttgcagttcctggcatctccaagcttctaggtgccaccatgttctgcagtgccagctgtggaagctgcttgtggtgtgcctggtccagctgcaggtttgtggagagccaacacctgtgccagtgcctagagctgcctgccccactgcagcagctggcatgtcggactgtgtgcagtggctggaccccacagtcattcacacaaccctcaccattccacgcctgactcgcccttggcgggaattggacacagactggtagtgcgagctgagtgcagcatgccagattgaatggtcaaaacaagcccaacaggcccaagcaaaattcaggcaaaggtgccagtggccacagaggtttcttgccagaaaaatgacaccccaaaggtcccataacattacaaaataacaaactcttatacatgaaatggattagtaaaaatacatgtgtgattaatatcattcataaacttagatgttaaaactaattaaatcttctgttaaaaggaacaaatttgaaaattactaaaaggaaacaaagataaatctccaatcactcaatagaacaggaagccaaagatggtatgcaatgtgtttccttccacccaccttgacctcccttaccaagaactctgactactctgttcaaatacagggtgaagaaagggcctgatttcacatggggtaggttgtgcccctggaacttgcactggccctgtccctaaacctgccacctggtggccctggctgcaacttgtactcatactccctcttccccctctcttaaagcctcttcttacagagacgggtaggaggtgggatctgtcccatggaccttggccacatactccaggactttcatcttgttggttttagtgtgggctcttggactctacaggaactcatagtgtgcaggatcactgctgggcacctggtggtactccaggtagttttcctgcacccagtcttgggtgagcagcttcctgggcttcccatagacactgtgcttcttcccagcatacagccccatcacactcagggtttcccatatgacctcttcaggggtgcagttgccctccattataatcgtgcacaggaccattatctggaggcctgcattgggcttgctctgatcatcacccagcaggccgtcataggagaggcccagggaagtgacaaggatgtaggagtggccagtggtatccacttccttcatgtcaaaaaaaaaaaagaccagccacatgcacttgaagatcacaggaaagtaatccttataatttttgatgacactctctagcatttctgcctttgtgtttgtctccttgactcaatacttgtagagcaggaaatgaaccaactcagtcaccttcccatcaagtgcttcttggaacaaggtcttcaggtctgctgggtctggtgaggtgcctggagcctcctcttggctgctggagccctcattagattggctccatagagtgttgtcaatggtagtgggggaggtagaggttccctgaggactctggggagaaccaggtgacccagcagcaggcagcccctccagggtgcccactgtcagaggagaggagaaggaggcagcctcctgttcctcagccaagggagcctgcacacccaccaggcccaaagcctcgtctccttcggcctcaaggctttcctcaggctcgcagtgctgattcctctgctcaggagacatgatgactctggtcagaatggcagagtgtgggcaggagctgggcaagtgggacccacaggcctgaggagagagggagccagtgagggacctcagctgagagccgaaccttggaggctctaacaaaagcagacttatggatcttttcatttggtgctcctctggggcctcctggggcacctatcctcctagctggcctgttcaccgagaacttggaggaagtgagagtgttacagtgggtagctagtcaggtatgaatagggaaggagagggttcccccagccccttcactcatgtgcacatgcatgcgtgcgtgcacacacacacactaggaatgttgggtgaccattaggcgatggtcaagtggttgttaactatttctgtaaagtaataattgttcacagcccttgccaggggaaggcagtctcctaatagaaaacacctgaaatggatcagcagcttcccaacaagatctcaggactggggagaaagtaacacaagatctctgaagtaggctgatatggtttggctgtgtccccacccaaatctcatcttgaattcccacgcattgtgggagggacccagtgggaggtaactgaatcatagaggcaggtccttcccatgctgttctcatgatagtaagtctcatgagatctgatggttattataaaggggagttttcctgcaaaagcttttttttttttttttttgcttgctgccatccatgtaagatgtgactttctcctccttgccttctgccatgattgtgaggcttccccagccacacggaactgtaagtccagttaaacgtctttctattgtaaattgcccggtcttgggtatgtctttatcagcaatgtgaaaactaatacatatgccaacataaaaccccaagtcaagaggtcaagctgtgactttggtttctcaagttgactacttggccctcttccgagttatacttttcttgtttcctttccttcctttccttactgttctaaagctttgtgttttgtttgtttgtttgtttgttttttgcctcagtctttccttctgcctttggcccctcagtcgaattctttcttctgaggaggtaagaactgaaattgccgcagacctatatggatacaccaccagtaactcagggtaacttgggtacctgccaccactaacaagagggctcctcagggtgcagcttgtcagcagaagccacggctccagcaataacagtaggacaggtgggttggcactttggagtcccctctgctctggggccggtggagccctttgtatacatttaaagtaaacacctcaccttgcctgctggcaatacctgggcctcctctgctgtatgacttcaggacactgcctcagaccaaggcccaaacctctctgagacctgggagaaagaagtgagggggcaccacacggaaaattctgcacgggattcccaaggctgacagaaggagcaggtttcaggggtgcctcctctgtctgcgttcctccaggtattcagatttattcccgacagggcccagccctttcgctcctgctcaactgtggatgagtcttgtgtgccaaggccaccatcttcctgggacccccaaggagaaagtgggggaccatgtcccttctccacaggcctgccttgggcctcccaggactgatagcagaggcagatttcctaggtccaggataacaggtctgctgagtcctctctcagggctctaggggacttctctctttgctggcctgaggccctactcctcatattacacccctctcgtcactggcaccccaaagacacagcaaagatgtgccacacacagccagcactcccaggacctcccagggtcgaggtcctctgagtcctccctcttcttcctcctcttgatcctgtcagggctgagcctcacccctttgtggacctgaatctatatccctcaaattcccaaggccaattgagaaggtgcctcagtctcagaaagaagtggagtaggccccctgttctgggttgctgggtcccctcaggcctgccttgtctcccagcctggcctggacccaccttctgctcccctgaggccgtgctcatgattccaagccccttccctccatcagcccccgatgtgaacatcaggatccacatgcctgtccaccatgcccggaacttcccagggctgacagcagagatggagcctcgctctgtgggatctcagccctccttcagggtctggaccatgatgcctggcaggcagagcatgggtcctgccctttcctaatcagcctttccctggtcacaccaagctctgtctccagaatgccctgcggcttaagtggcagtggagccgggagcggcccagcctgagaagtctgcccccaggtggcccagggctggcagcaggggtggcactgggttaattggggtcctctctctggggtaggggcatcctcagtcttcctcagtgtctcaccttgcctcctcacagagccggggcctgtttcactccaccaatctcaagctgccactcagagcgaggcgctcttgctatcctctgacccctgaggccacgtcagtggcgtgacatccggcccccaagcctggggcttccctgggtcgacagcagcagcggaactggattcttccaggcatgggggtaggaatggttataggggccctcaagcttcccttagggtcctgacattgattccttgcagagcctggacaccctgccctctgccaattgggtctgctcccttcacaccaagtctctgactcccagtcccctgaggtggcagtggtgggaggcgtgtgttcagggcgacaacattgccaggatcttccaggattgttagaaggggctgagctggattctctggttcctctacaaggggagggtggactctcagtcctcactcaagaggatcctcctcctggctcttggatctttgatgaagccatgggcaggagatactctgtttctgccacttctgagcatttgcccagctgcatctcttgcagagaatggctgcgggtcccaggccaggtactccctgcagagcggcagcttctgtgattgtagtgacctctgggagaagacacacaccttcccaaggaagctcttccccagccacaggtcgagtttgcaaacctgttttcctaaaatatttgtttttacattaaataggctgagcagcagcatgaaatttggggattcctgccattagaattatcgagtatttcatagctcagtgcagtgattttcatttttaaactttcattcagcatcagaaatcatacttaacctcattatgcctgtttcattctaatgctcaacactctatttgtaatccattctttatgttcagttaagccaattcacctattaatgtggttttaggtggttattagcacagactggagctactactgtttcaatgaaaccagactactggcacctgtggtctcaggtgccacctgacattttcacactggaataggggcaaaaatttaaacatttccttctacacatcctgtcatcttccttctatgccagctatggactctccctaacttccttgacactctggccatttcgattacaggtaccagttaaacacagtcttcattctcccccagggctttgctttgttgtttagattttgttgttgatactatttgtttttttattttattttattctttcttctatagttttccaggattgattttggtagttgagggcagaagtccaagcctgacattcatcttggcagctaaattttaagcattatatctgtaaatcttgaataagaaaaattgatatcttttcaatagtctgttccctattaagggatatagaatacggctctgtttatctgggaactttttgacctaactctatcagtacttgcatagttgtttccataaagatcttgtatgctttgtctgtctccattggataatttctagattttgttgccattgtgaatggggtattttctattacttgttctgaatagttatttatttgggttgcaaggattttgattttactgtagtaatcttctgtatactatttttctgaagtctgttatttgactattccatctgcacaattctttgaattttctagataatcatattgtcgtaccaaatattaaatctgttcaatatttatactgattttttttttatatccacctctctggccttatgttacagtgtaatttccaaagatagaggttatagcatagtcct

SEQ ID NO: 631 - DNA, 47790 bp, Homo sapiens
cagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaat

SEQ ID NO: 632 - DNA, 125524 bp, Homo sapiens
aaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggccccgccccactccttccggccgtgcagggtgggtgcctctggcgcccgggacttcgcccggtgctagggcgtcagtctcccattcggaaggactgggccggggcactctattcaatcgcctttagtgaacatacttgaagctataggtgcagggatgagaaaaaacaggcccataaagctataaaacctgggtcccctgcctgccatttcagtgctcctcccgagtcctcccactacgcttctatttatggtagtttatccaggtttactagaagtaaaattctactacctttccaccattttcttgagtttatggaagtcatataccgctcattactcccatcgattcagctgagcatcttgaacccagggtccagatacagtgctacatacagtgagcactagaagggaatacccattaggaatgaacaccttatgcaggtaaaaatttaagaacgatacatattacaaagaaggaccaaaaagtatactgaaatagtatatgcaatggaaatccaaggcagatttaaaaaatgagagtaagaacaacaaaaaaaatcaaatgcatatatactgaaaatgggaaattgtgcagtattatatttattcgagattaaaagtgttaatctaatgtcaaaaaagcaataaaggaattggtttgtagaagtcaggatcaacaaaagaagaaaaagcctccacatctttgccctggaattccttctgccatgaatgctcttacccggcacttgtttatttggaaaacggctactcgttatttttgactcaatttagatagcacctcctctgtgaagccttccctgtctttcccagataagtttgtatattttttttccctaggtccagtatgcccaatggatctcgtacaggcctcaagagtaccacttactctagattataatttctctttctgcatgtctttgtcctctaatgaataagtagcttcttgagagcagaaaacttgtgtttttcatatttgttctccaagcacagagtctaaaatgtctatatatttaataaatatttgttaaaaaatttctagaaccagtgtgtaaacaaaaggacatatccagagtgtgaatgtaacataaagaggaaaaactaagtacaatgagaatctagatttagtctggctggtattcattcatgcaataaacattaatgagtgcctactgtatgccaggcactgtactaagatctgggtgtaaaatgataaacaaagcccagatatagtccatgcccttatgcccttatgtttaaagaacaaattggagttggccaggcaaatgggaaaacaaaaaaagttttgggcagaaagaacagcatgatccaatgtcctgtaacaggaagatcataactgtagcaattagagtgaatgagctcacttaaagctaagctgaaatcaacacaaagtactcagaaaaggcaacaggttgatagacaatacctgtttgtttgagtcagtaaaagaagcaagtttccttaataatagtaaccaacatttataaaatgtgcactatatgctaaacactgggctaagtgtttgttttatatcaaacacttaaggtagatgatattatttctactttaaggataaggcaactgaggcacagataggttaagcaattttcaccaggatcacatggcagataaatttcagagctgagattcaaacctaggtaatttggctccagactctagggagcctggatattttacttttaataaaatataaattttacttgtaataaaataaaagtcagatattttactgtttcctctctctgtgtgtgtgtgtgtagcaggtcacatggtgtatggcacagagtggaacttcttaatatttttggaatgaatgaatagctgaataaaagcaataggtacaaatgtgctagaaaacaaaatagaaaaaaacaatagtatctgggtctttttatgttcccgccacaccagctgttcctagaacacaccaaacttgttcttgttctgcttccaaaatataatctgctcatgcatttgtccctcactgtactgctaacattccggaccagagtttggctttttttttttatctgtgaagggtcagctggtaaatattttaggctttttgagtcacatacagtctttgtctccaggtattaaattctgctttcatagagtgaaagaattcacagacaatacataaatgaatgcgtgtaggtatgttccaataaaagtttatttacaaaaacaggcaagaggcaggatttgccctgtgggcaataatttttagactcttgctctaggccaaattatcaccatctcttgcatggactactgtattaaatgatgtctgagagccatcatctttgactaacatctacacctttgttttatcagcctctcagtgaagctttagtgatctctaatcatattcataaccttgagttcttgaaaggtggttaaaactatgtgttaattgtgattgtgaacttcgatttatcaaagatggtctttaaaagaactactagtgatctttgaaagagttaaaaaattaaagaaggaagatttattataaaagtagtgacttttagccagaaaataaatattctggacacagtgcaatgttgaatttggctgaagctttggtctatgacaagaatcctgctaggtattctatagagaaacaaataaatgctaaaacttttcagaaatcatctagaccatacaaaattttcctcacctattcatggacaaaaatttggtaaagctgaagggtatattaatttgtgtttcggtttatgaacatttctgactctggggatatgaacatttctgactctcaacagaaatgtgattcagcataaacgtagtaacctatacaattaattttgcagtgaagaagtattaattaggactcattagttaaaagttatcaaaacctacctgaaactaacaagcaaaagagagaaatttatgggaagataataaggtgtttcacagaactcaagaaggattagaacaatcaaaacttttaaaaaggcaaggtatagttaggcctcaagaatcgtcaaaaacaaggattccagtgacattgactctatcattcttttacccctatttttccctgcacatttatctggggtctctctctctctctctctctctctctctcctctctctctctctctctcttctctctctcttctctctctctcatcccctcgttcccttccttgctttcctccccactcctctcaagctctttttgtttcccaagtccatgtaacagtagatacggttacggacaccttcctagattttcatattacagattcaaccactgaagagagacactaagccatatcaggtcctctgaaaagcaaatctacagatctatcgtgggtaatggctggcaagataaagaggagattacagtacagctctatggaagtctcaaccaccccaacagagactgctaattagaggaatcctgcgttagacagaaacagccctagtacacctcttgtgctcagagattggctggagatgcctgggaagggaatggccttggatcaaatgatgcaaaaataatcccaaaagtgctccagctggagactgttagctgactccactcctcatagtaggttttcccttgaaagatctgagaggcactccctggttaccatagacctttatggtcctatctccataaatctatgagggatttattggccaagtttgagactggtggccacctaagaccaatcaactgtagctaggtgagcgatgtcacatataccaaaggataattttctcagttttcctggggctgaggaattccctgtaatgtgctaaaaccacaacagttcagggcaaactaggatgcttagttattttattagtacccatgttaataggggtgggaaagttaaaaccgtccagtaatatcctactatataaacaattgtactttactgtatttatggaggaaattctatgtatagtggttttattggattaggataatttataaaggtctcagaagaattcccttgaagatgacaaaaatttcatactttaattcttgcatgctggttcccttgtgcatttatacattcttcctccatctagaatgctcctctcactgcaacctccctctcctcaaccttgtcctcactgttagaaatgcttcttgcccatttctctagtttccacatggaattatttctctaaattaagattaaatcacataataaatgccaagcacatatcataggacatggcataaaataggggcttgtatcagtcaaggttcttagttgcatgcaacagaagctgaagctgactgatttaagcaggaaaaaaagttatgttgggaatgacactggatcagcactcttgccgttagaaacatcataaaactgcataaaatatgcaaggaaactgtttaaagatattgagcaatagtcagcccatgattatgatccccaggaaaagagaaactcacaaatcaagccccaagactgccttagctctttgcctggtgactattttctgatcccagcatcaagagctagattccaagctgagcttgcagtctcattgaacgaaggaggaaaagatcagagctcagggtagcagaagcatctgaaatctatggagcaaggcattagagaagacaatctgtgcagatgttgggacgggtaaacatatgtcttggggtttccagcaaaactttaaaaagaggaggagttatagaacttcttggtttcaagactaactataaaactacacttatcaaaacagtgtggtattagagtaagaaataacaaataagtcaataaaatagctcagaatccagtaataggccgacatatattatggtcatatatttctttggttttaaccttctatttggaaataattgtcaattcacaggaagtttccaaaaaatacagggagacctcgtgtaccctttacacaatttcctctgatggtaaaatcttgcctaactctggtacaatatcaatccaggaaatttacattggtaaaatccacagagcatatttgaattttaccagttacacatgcatatgtgtgtgtgtgtagttgtataaaatattctatgtgtaactttgtataatgacgaccacaattaaaatgtagaacatttccattgccacaagctttctcatgctgcccctttatagccacactcacttccctttctcctcctcaacacctggcaaccattaatatgttctccatctctataactttgtcatttcaagaatgctatattaatggagtcaggcaatatgtaaccttttgggattggctttttttctactcagcttaactccctttagatccatctaagttgtgtgtgtcaatagttgattcttttttattgttgagtggtgtttcatggtatgtatgtatcagagtttgttcaaccaataacccactgaagaacatttgagctgttttcagtatttttctattatcagtgaagcttctatgagcattcttgtacacatgtgttttttttgggaataccagttttaatttttctggcctaaatgtccaaaagtatgtttcctgggttatatgctatttgcatatttaatactttaagaaactacaacaccgtcttccagagtggctgtaccattttatattctcactgtcaatgtatgaaagatccagcttccatgcaacctttccagcattttgtactgtattttttatcttagctattttttatgtcaggtattctgacaggtctgtggtgatatctaattgtgattttaatttgcctttctctgatgatgaatgatattgaacatattttcatgtgcttattttctatctgtatataatctttggtgaaaggtttcttcatgtcttttgcccattttctacttggattgttcagcattttttatggttgagttttgagaactttatatatttaacatactaattctttgttagatatgtggtttacaagtattttctcccactctgttgcttgtcttttcatcctcttaagacaatattctgcagagtaaaagttttgaattttgaggaatccaatctaccaagtttttttatggattgcgctttagatgtcaagtctttactgaaacctatatccaaagattttatcatgtttttaaaaaaagttttatagttttgtggcttacatttaagtccattatccattttcagtgactttttttggtaaagtatgaaatttaggttgaagttcatacttttgcctatagatgttcagttgctccaggactattgcttgaaaggctatccttactttttttttaacttgcttttgcacatttgtcaaaagtcagttgggcaaatttgtgagggtctgtttctgtttttttgtatttggttccattgatctaagtgtctatccttcagccaatacaatgctgtcttattactttaatttttttatatcattaccaatgcctttgaacagggaaattctcttaaaccactgaaagttgaagaaaatgaacctcaaactctacctcataccataaaaaaaactcaacttagaattaatcatagacctaaacgtaaatgctgaaattgttaagcataaggaagaaaacatgggagaatatcttcatgatcttgtgttaggcaattgtttctcaaaatagaaaaaaaatcattaaccataaaagtttaaagtgataaacttcattaacattaaaaacttctgcatgccaaagacattgttatgaaaatgaaaatataagccatggactaaatacaaaatatttataatacctatatcttacaaaagtaaggtatctataatacatatagaactcttaaaatcaaacataaaaacacaaacaaacccaattagaaatgggaaaaagatttaaacatatacttacaaaagaagatgtacgaatggccaataaacatatgaaaagatgttcaacatcatttactcttgaactgaaggaaaagttaaatcacaaagacacaacacttcacacaagctataacatttaaaaaagaatgatactaccaagtgttgatgatgatgtggagcattttgagttctcatacattgctgatggcaaaataaaatggcacaattgctttagaaaactggttagcagattcttataaagttaaacacactttataagattcttagttaaacacactttataagattcttagttaaacacactttagcagattcttataaagttaaacacactttataagattcttagttaaacacactttataagattcttagttaaacacactttagcagattcttataaagttaaacacactttccctatgactcagtaataccactcctaagtatttacccaagagaaatggaaatatatactcatacagtcttctgcacaaatttttacagcagttttatttgtaatagctccaaactgcaaataattcaaaacatgcaaattgataattaactatacatccataaaatggaatactactcacccatataaaataattactcgaaagcaacaaacgtagatgaacctcaaaaacattatactcagctaaagaagctagacacaaaagaatacatactgtatgacaatttatataaaattctagaaattccaaaattaaattatgctggtagaaagtagaataatggtttcctggagcagaggagttgtgtatttactggaaggagtaatgacaaaacccttcggagtgatgataatgttctgtatcttgattgtgttgttggttacacagtgtatacatttgtcaaaactcgttgacttgtatagttaagatctgtacatttaactatatataaactatacttcaataaaaattaagttagaaaaaacagatatttggtggctaacagaattatcatgaatcgtggagaaccaggcatgggctgggtgtctaggaccaccaaccaaaaattcactgcacaactggtgtgacgaggaaacctcttttactaccacaaaggactagatgctactatatataccagtgctatttctacaacagaaaatcaactttactgcagccagtaatgccaatggctgccgcttctatgctggaaacccgatttaccaactattattgttcacagagtcagtatgagtgcaagaatatgcaagaacagctaagttttgtgatcaaactctgtcactatcattatcttcagtttattctgcttatgtgattctgaattgtttttaacttttgttttagcagacattctatgcacgtcttgtactataaatagcttaaatccattttggatttaagtcaagaaatgcatacaacaatgaagtatattctagtcatcaaaccatattaattttttctcatattacctattacattttttccagtcttactgttggtgaggcaagaaccctgggctctggagtcagacaaacataggttttaatcctggtctactcacattgtctactccatccttcctggattttcctttgttctaccactctcccacttccatgagttttcttctccctaaacattcctttttgtttcaactatttctcataaaatgagttgggctatcatcatatgccaacaggaaaaaatgtgtcttcaagggtctgtaggccaagttaccaaatgatgtcctctccactctggtagtcagggtgatatcagcaaaggtcccctcatttcagtatggtcaaagatttatttgaaattcagtgtattaccagcaatgcttggcccaacttctctagtatgactgacttcctgagcaagagactcaatatatctggggctccagagcagccaaaggtattcaagggtctcttcatttataccgtatcttattacacaacgtctatgcatctgagaaaggaacttcaccaacagagcagtgcagaagaccccgacatgggttccctgccctgcttttactacaaactcacagaagccaaaggctacccgcaaagggcaggtgggtggtcctcactatcaagtcagtatctctggagtatagggccacctcctgtacaggcattaaggtcaacaggcttcatgtagaagcaatttcaaaccaacacctgtgcttgtcagagcatgatgggcattcagaaaaaccctcactctgcacttttcacactctaaagtcagactgttggggctataaaatatatgtgatgcaaagtatagtaactttcagaggactaacaagaaattataatatcactgcttttggaaaataggttctagtggccctagggcatgtttcatccctgaaggattgtgggtattgaaaacaaaccactacctgcagttaaagtgagaactccatgctgtaaaatcagtgttaaccagacatcctacacttatgtgatttgtcttaattagagtttgagctccataattcactgtctcagcggcttattctggctgtatccctcaagtttgcacagccaaccccaccttcattctgtagtggaacccaaataggatcctatctattggagccatgtctgctaagtaaaaataaaaatggagatacctagggcatgactttgcactacaggctgaaaatgctgcagtttgtgcagaaagcagtacttgtacaaatttctacaaatcaagaattagaagaggagaaaataataatgtggatcatcacagtgtcctggaaggttccccctccaagtttcttcatatttaaaagatagcagtctctcaaaatgttaaattatctgaagatgatacttttatcagtaacttcttgagtcaagcagaccaacagatgggtctgtaaatttggaagcaaagacccaagtgggaccataaagaaacatttataacagatatccagcattcattaaggggtctcaattaaaccactgcctttgctagaactccatacatatgatattgcatttttcatcatatattaggattgctttccccaagtatatgaaatcaagagctaagagaaatatcaaccaattgttttggaatccccagctaggccaaacagaatcctatatcctgattcccatcactgaacctcacagtggggctgacttctgatgtgcagctgattgattgctgtcacatccttacctatatgtttgtggcctcacagacctctagcaacttaaaggatactgggccaaatttcacaaattaatggcccatttcagggattgagtatataaaagtaaataatatattcagattacctaggatcttcttttctttatggctattgtcctctatgactctatttatccatgaacttcattgcttcttagaatcattttcctgaattacagtgtccaaaatgaaagtccacatttttttcaacagaggaatgggcacttttctgaaaataagccatatcatattgaaatacagttacacaaaatatgtgaagataccttatttaaatcatttcttagaattatagaattttagagaaaaaggaactttatgcactttttattgaacttgttttgatttagttaagctctctcattttacagatgtggaaactcatactccaaaatattatgaacaattttgcccctgtattcacctgttaccagttactgctctatctgatgctgtttttgtcttcagtagaactgactcgccctgaatttttcatgttttagttagaacttgtcattgcttactcgtgggtccagacgctagtccaatatgcatcagaagaacttgcaggtggtttattttctttccacttgctcttgaagagacagctttgctgatttctgcatttcaaaacctgtctagtaccagacatttcatgaagaagatcaaaagctctcactctaagtgaaacaaaatttggtttaattaatagctgtgtaagcttaggcaagttacttaacctctctgtgtcttagtttttgcatctgggagataaggttaatgacacataccttgcaggattaacgtgtgaattaagtgagatagtgaatgtaaagcacctggctcagatttagagtgtaataaatcattgcagtttttcttatctattaaacacaatattgggaaaagcattatatggctttttaaaaaacattccttgttagataggaggctgcttttttcctttttgaatcttcagtgcaaataaaaatgtgggaaaatgtgcagcaaaatggtttatttttggcatttgcctgtttaagagagttcctcagctactttagcaattcaattaatgcgcctcttctctccagggattcatctggcatttatttacaatgagtttccttttcaactaactaccatacaccaggtaacctgagcatatctacaaatcttttaacaaaattgttatacaaataatgtatgttttagatgaaaaactagaaattacagaaaaacacaaatgaagaaaagttaaatatttatacttttaccactttcttacagaaatacattatttacctatctgtatctatataatctatatttgcatctatcatctatttatctatcatctatctatctatctatctatctatctatctatctatctatcatctatcatctatacatctatttgtggccatagcaacactacaaaatcccttttaaaatgatcagtttccctctggcaagagacttcataatgtagtattttcactgattagtttcatatgttatttagcaggcctgataacagtgtataatagcaaataaattttaatgaagtagacaatttaaattgtgcattgacagtaatttcatagtccaggataatgaacttaatagactacagcagagtatttcttcctttttgttttgttcattcaacaaatgtttattaaacacctactatatgcctattctgagaatagaacacggaataacagatagaaatggctactggcaagaaagttacattctagtacaaacgtaaatttcttctcttaatacaatgtgatgcaatgcaaaaatgaaacacagaatagttgagtcaattcatctaagtcactaaactataaaaggaaacaggaaaataaaaggagctattaactttattccacatttcacagctttgaggcatctttttaaaacacttttttgatcaatttttttaattttaattgacaaataattgtgtatatttatgaggtacaatgtgatgctttgatttatgtatacattgtagaaagattcaatcaagctaattaaaatggaaaattctaaacctgtactagagagaatgatacactgatccccatatacctatcattcagcttcaactattcaattaatggcaaattttgtttcatctagattattttgaagcaagtcccttatattttatcttttcatctgtaaatgtttaggatgtacctataaaagataaaaactgttttattcaatataaccacatgcaattattacaacaattttcccctgatatcaaatatatagtcagtatcttaattggtcattatgttttttaaatctctttgaatagatatttcctctccttccttactttttttcttgttatttatttgttgaagggtttttttgtttcccacagtcagttttgcctgtgaaaatgtttttaaacaactttgttgagatataattcacttatagtaaatccagtatatccacagagttgtgtatccaccatcacaatcaagtttagaaaattttcattaccccaaaaacaaaccctgcatcccttagccatgacaccccaacatcactccctaccactggcaaccactaattcattttctgtctattattccagacattttatataaatcaaataatacaatgtggtcctttgtaactgtattatttcactgagcataatgtttttaaggtcaattcatgtttcatttcatttcttttcatggctgaagagtatttcattatatggataaaccacattttgtttctttttattggttgatatgcatttgtgttgtttctacttttggcttttgtgagtaattccactatgaacattcatatacaagatattttgtgtaaatacattctcatttttctagggatggaattgctggattatatggtaattctatgtttaaccaattgaggaactgccacactattttccacaatggctacacaattttacattcttactggcaacgtatgaggtctccaatttatccacatcctctccaacactcattttagttgatttccttattattattgtaactatcctagaggaggtgaagtggtatcacattatagtttagatttttatttctctagggactaatgatgttgagcttctttttatttgcttattgttcatttgaatatgttatttggaggaatacctatgcaaatccttagcccagttttaaattggcttatttttcattttattgttgagttgtaagagcattttacatattctagatacaagatcttgtcagatatatgatttgcaaaattttttcccatctgtgagtagtcttttcactgtcctgatggtgtcttttgaagcatactagtttttaattttgatgttgttgaatttatctattttcgccttttgttgcttgtacttttggtgttatatctaagaaactactacccaaactatagtcataaggagttacatctatgtttcttctaagagttttatattttagctcttacatttatatctttgatacatttttagttaatttttatatatgatgagatgtaagggttcaacttcattcttttatactgtcggcatgttttcagtgtcctgtttttttagccaaaaattaccacgtaagtaagtgttccctcagttcaattatctcaactcaatatgacctgagaaagcattagaatttgatagggagcagaggtttcaaatcattctaccccaaagctccttcatctgaagccagagctggtatatctttcttttgttaaaatgacagataaaattatatgtatttattgtgtatagtatgatgttttgaaggatatatacattgtggaatggtaaaatctacataattaacaaaagtgcattatcacacatagttatcatattcgtagtgagaatgcaacatccaatctcttagctatttttcaagaatacaacatattgttattaactatagtcaccatactgtacgatagaacttattcctcctatttaactgtaattttctattctttaaccaacatctctccacctgccccctgtaaccaaccaccctgccctctaggtagccaccattctattctactttaatgagattaacttgtggatttcacacgcatgagatcatgcagtatttgtctttctgtgcctggcttatttcacctaacataatgtcctccaggttcatccatgctgtgacaaataacatgatttccttttttatggctaaataatattccaaagtggtactggaataatatttcaagtggtatatatgccactttttaaatccatgcactcattgatggacacttagttttattccatatcttggctattgtgaatagtgctgcgataaacatgggtatgcagatatctctttgacatactgattacattttctttggatatatacccaatagtgggattgctggatcataagctagttcttttttaatttttttaatttaatttaattttaagttctgagatacatgtgcagaacgtgcaggtttgttacataggtaaatgtgtgccatggtggtttgctgcacctatcaacccatcatctaggtattaagccccacatgtattatctatttatcctgatgctctccctcccaccccccaacaggcccgttatgtattgttcccttccctgtgtccatgtgttctcattgttcagctcccaccgtgattgagaacatgcagtgtttgattttctgttcctgtgttagtttgctgaagatgatgacttccagcttcatccatgtccctgcaaaggacatgatctcattcctttttatggctgcatagtattccatggtgtatatgtaccacattttctttatacggtctatcattgatgggcatttgggttgattctatgtgtttgctattgtgaatagtgctgcactgaacatacacgtacacgtatctttataacagaatgatttgtattcctttgagtatatacccagtaatgggattattgggtcaaatggtatttctggttctagctccttgaggaattgccacaccgtctcccacaatggttgaactaatttacattcccgccaacagtgtaaaagtgttcctatttctccaagcaattgcaacaaaggcaaaaattaacaagtggggtctaattaaactaaagagcttctgcacaggaaaagaaactatcatcagagcgaacaggcaacctaagaatgtgagaaaacttttgcaatctacccatctgacaaaggtctaatatccagaatttacaaggaacttaaacaaatttacaagaaaaaaataaaaaagtggtcaaaggacatgaacagacacttctcaaaaggagatatttacgtggccaacaaacatatgaaaaaaatctcaacatcactgatcattagagaaatgcaaatcaaaaccacaatgaaataccatcccacaccagtcagaatggtgattattaaagggtcaagaaacaacagatgctggcaaggcttttttaaattttttgaggaacctctgtattattttccatagttagtatactaatttaccttcccaccaacagtgtgccagggtttccttttttccacatcctcaccaacacttgttatcttttgtctttttggtaatagccatcctaataggaatgaggcaatatctcattgtggttttgctttgcatttccctgatggtaatgatgttgagtattttttcacatacctgttgaccatttgtatgtctttttttgagaaacactgattcaggtcttttgcccattttttttcttttttctgttttcttttttgtttttttgttattgtttcttttttgttattatactttaagttctagggtacatgtgcacaatgtgcaggtttgttacatgtgctatgttggtgtgctgcacccattaactcgtcatttacattaggtattcctcctaatgctatccctcccccctccccccaccccatgacagacgccggtgtgtgatgttccccatcctgtgtccaagtgttctcattgttcaattcccacctatgagtgagaacatgcagtgtttggttttctgtccttgtgatactttgctgagaatgatggtttacagctccatccatgtcgccacaaaggacatgaactcatccttttttatggctgcatagtattccatggtgtatatgtgccacattttcttaatccagtctctcattgatggacatttgggttggttccacgtctttgctattgtgaatagtgctgcaataaacatacgtgtgcatgtgtctttatagtagcatgatttataatcctttgggtgtatacccagtaatgggatcactgggtcaaatggtatttctagttctagatccttgaggaatcaccacactgtcttccacaatggttgaactagtttacagtcccaccaacagtgtaaaagcgttcctatttctccacatcctctccagcacctgttgtttcctgactttttaatgatcgccattctaactggtgtgaggtggtatctcattgtggttttgatttgcatttctctgatgttttgcccatttttaaatcaggttatttgttctcttgctattgacttgtgtgagttccttacttccttattagatacatagtttgcaaatattttctctcattctctccactctgtttatttcctttgctatacagcaactttttagtttgatgtaatcccatttgtttattttcacttttgttgcctgtgcttttgaggccactgtgtagcttttcccatatgttttcttctagtagtttcatagtttcattctgttaggcttacaaaaaacatcatatagttataacaggttgttttaagctgacagcaacttaactttgatagccaaaaaacaaacaaacaaacagaaacctacagttttaccccattcttcactcccacattttgaattttttgatgtcaccatttacatattttaatattgcatatcccttaacaagttatcatagttattatatttgataatttagtccttcaatcgccatactaaacatatgagtgatttacatgccaccattaccatattattctgaatttgactatgtcctcacttttactagagaatttcatactttcaaatgttttcatgttactcattagagttctttcttttgcagcttgaataattcccgttaacatttcttgtatgacaggtctgatggtgttaaactccctcagattttgtttgtctgagaaagtctttatatttccttcatttctgaaggatagttttgctggtatagtattattggttgacagtggtgttttttcttttcagcattttgaatatatcatcccattctatgctggcctacaaggtttcttctgagaagttcactgctaggcatattggaactcccttatataatatttgctttatttttcttgctgctgatttcaggatcctttttttgtctttgatttttaatagtttggtcatagtattcttatttggattgaatctgattggagacttttcaccttcctgtacctggagatttatatctttctccagatttggaaatttttctattatttctttgaataagcttagatccctttctctttctcttccccttcatgaacccctataatctgaacatttgctcttttgatgctatcccataaatctcagaagctttctttattcctttttattccttttcttttttctcctttgattgtatttttttttatttcaacttttattttagatacgggggtacatgtgcaggcttgtcacatggggatttgtgtgatgctgaggcttggggtacagatcctatcactcaggtagtgagcatagtacccagtacgtaccttttcaaccctcacccctccttctctccctgctccagtagtccacagggtctattgctgtcatatttatgtccatgtgtgctcagtgtttggctcccacttttaagtgagaatatgcagtatttggatttctgtttctgtgttaattcacttaagattgtggcctccaactgtatccatatttctccaaaggacataatttcattcttcaatatggctgcatagtattccatgttgtatatgtactgtattttttttatccaatctgccattgatgggcaccagggttgattccatgtcttggctattgtgaatagtgctgtgatgaatatatgagtgcatgtgtctttttggtttatgatttattttcctctggatatatacccagtaatggaattgctggatcaaatggtagctctgttttttaagttttttgagaagtctccagactgctttccacagggctggactaatttacattcccatcaatggtgtataagcattcccttttctctgcagccttactagcatctgctgtttttttgactttttaataatagccattctgactgtatatttttgaataatctttcttcaaattcacattctttcttctgtttgatcaattcagctgttgattctctctattgcattttttattttattaattgcatttttagttataggatttattttttattgttaattttaatttttgtgggtacatagttggtgtatatatttatggggtacgtgagatatcttgatacaggcatgtaatgtgtaataatcacaacagggtaaatgggatatccatcttctcaagcatttatcctttgtgttataaacaatacaactacactcttttacttatttttaaatgttcaatttaattattattgacaaagttattaatataggtacacttattagagattatggatttagtgcattagcttgtacagaaggaagtaactctaacagcttctttggctagttgactaaaatttggactgaatggcagcctacatttaaatcagttgagatgttagaactttcgtgacataatgtagaggaaggaatatgaaagcttagggagataggaatgatggagtgaattcatcatatgtgatttccacagccaccacacacacacacacacacacacacacgcacacacacactgtatcccccaagatggcccagaaaatattcctttcactaaggttttgagaaatatattagtgagaagagcaccactgtattagtcgcctagtgctacattaacaaaccatcctcaaacttggaagattaaaaaaaacatttatttagatcacaagtttacagattgacctagtggttctgctgtcctgtgccaggctcagcttaccttgacaagactcactcatgcttgtgacatcagccagcaggtcatctgagggctggctggtcttgaaagaactcagcttaaatggctcatctctattccccattgttttctcatcctccagcaggctagcttagggttgtttatatgactgtgaataaggttccaaaagagaaagtgaaagtgtacaaggctcttgaggcgtgagctcaaaactagtgcaatgtcacttctgtcacattctattggtcaaagcatgttacaaggctagactagattcaaggcatggggaaatatattctacctcttgataggaggttattcgccacagagcaaaggagcatggatacagggaggagtaaagaattgtggccatctattcaatctactacaatcagtgcccttgtaaagttctgtgatggttgtcttacgtaggccaggtatgacagtggaaagttacaacactgagatgagtgccctgatatcagtcagtatgttggtatccctgagtagcagaggccaactgtcagcccttaactacaagagatgagagtaagtactttaactggaaataaggacaaagtgattatcacaatgttttggtcctcaacaatttttgatggcagctaattcatcacagtgtcctttggaatgaaatagatgggtagattactaaaatgatatttgatctaaacaacaagaatctaggtttgatagaaacttgacttgaatcactaaaatggaaattcatggctcctcaaacccagttctaaaacacctaaaaagttcatagaccaggccgggcacggtggctcacgcctgtaattccagcactttgggaggccgaggcgggcggatcacaaggtcaggagatcgagaccatcctggctaacaaggtgaaaccccgtctctactaaaaaaaaaaaaaaaaaaaaaaaaaaagttcatagacctagagctctgtgatcaaaggagaggataggtccccttgatgaaacaccccggagcactgccataaatatatactgtaaaccttatcccaaaccttctccaaagggacctatagccatttaccgtggtgacagcatagggaaaaggaaatagccagatcttttgggggatattagacactagctctgaattgatgttaatttctgagaacccacattattacactggttcacgagcttaaatgtgggcttatggaggtaagatgatagtggagttttgacctatgtttgtgacaagtaaatcagattacccaccctatggttattcccccaagctcttgaatatataattggagtagacacattcagacagtggcagaatcttcacatttgctctctgatccatgaaatgagagttattattgtaggaggaggcaagtataagcctcaagaacttcccattagtaacagaatagtaaaccaccatggtgaaaccctgtctctactgaaaatacaaaaattagctgggcgtggtggcatgcgcccgtagttccagctactcgggaggctgaggcaggagaattgctcaaacccaggaggcggaggttgcagtgagccgaggtcacgccactgcaatccagcctggcgacagagcgagactccatcaaaaaaaaaaaaaatcagaatctatcgcttcggtgaagttttcttgggatccaaaggacaggagcattttgatatatcttctcacatgccttacctggatattgttactgttgagtgcctagcctgccaagataggagaggaacacttggagagagcaagccatccacctggtgacaagttgactgcgtaggatagcctctattaaggagtagtaaatgatttttcctcactgaaatagacactggctctgagtatggatttaccataatatttctgctacctttatcatgtgtggacttgtgaaatgtcttatgcaccatcatgatattctaatgacattgattcttaataagaaactcaattcacagcaaatgaagcacagaaatgggcttataccatggaattcatttgactcaccatataccaaatcacccaaaggcagctggactgactgaacaatggttaggctgctgaagatccagttgtgacatgagttgggagacaactcctaaattttgtagggttttgttttgttgcattatacttggccagattatttgtgtaaagtgcagcaaaaataattattttttacataggtgttttaaattagctttgatggaactttgttccatagaaggatcctcaaacaatacttttttaaagctgagcccagccatggatttgtattatcaaatacctgtgagttgggtaaactcctctcctcttgaggtcgcaagataacttagggctcctgggcctaagttatatatatatattatatatgtacactttatatatataatatatatagtatatgtataaagtatataaagagttctggggtacatgtgcagaacatgcaggtttgttacataggtatacatgtgccatggtgctttgctgcacccatcaacccttcatctccattaggtatttctcctaatgctctcccttccccagctccccacctcccaacaggccccagcgtgtgatgcccccctcccatgtccatgtgttctcattgttcaactcccacttatgagtgagaacatgttgtgtttggttttttgtttttgtgttagtttgctgagaatgatggtttccagcttcatccatctccctgcaaaggacatgaactcatccttttttatggctgcatagtattccatggtgtgtatgtgccacattttctttatccagtctatcattgatgggcatttgggctgcttccaagtctttgctattgtgaacagtgccacaatagacatacatgtgcatgtgtctttatagtagaatgatttatattccattgggtatatacccagtaatgggattgctgggtcaaatggtatttccagttctagatccttgaggactctattcatctgacaaagggctaaatatccagaatctgcaaagaacttaaacaaatttacatgaaaaaaacaaacaaccccatcaaaaagtgggcaaaggatatgaacagacccttccccaaagaagacatttatgcagccaacaaacgtatgaaaaaagctcattatcactggtcatcagagaaatgcaaatcaaaaccataatgagatatcatctcacaccagatagaatggagatcattaaaaagtcaggaaacaacagatgctggagaggatgtggagaaataggaacacttttacactgtcggtgggactgtaaactagttcaaccattgtggaaataggtgtggcgattcctcagggatctagaagtagaaatcaaagtggaagtggctccataccatggaattaatttgacttaccatataccacatcacccagaagcatctggactgactgaacaatggatagactgctgaagatccactgtgacatgagttgggagaaaacacttaaattttgcttttaagaaccaagaaatcaaagtggaagtggctcctcaataactcacttaaagaattttggttcttgttctggtaaatttgagcactgctggcttacaggttttacttaccaggggaggaatgctttaatcggggacacaatgattccattgaattggaagttgagactgccacccgctattagctatttggaagttcttatgccagtgaaccaaaaatcaggaaaggctactctacaggctggagtgattgatccagatctccaaagaaattaggttgctgtcccacagtggggtcagagaggactatgcttgcacttaggaaattctctggggaacctctttgtatttctatgctgaatagtgaaggttaatagaaaactacattaagcaggaaataggcaagatttttaaggattcagaccattcaggaataaagctgtgggtctccctaccaggtaacacaaaatgggctaaggatatatgaattagttgaagaaggatgttttagatattaactacaacccaaaaccatatggtgtatatgtagcaatgagacagtctcttccttgtttttatgtaggtaggtatgtatgtatgtatgtatgtatgtatgtatgtacgtattatatataaactgtatgcatatattgactaatttatttttatttctcttctttccccttattattttatataaaatcatttttggaagttaactttacagtttagtgtttatgtaaaaattttcagatgggactgtaagtgaatttgaagagaaatcaacatagttcagaggcaaatacagtaactattgtgactttgtcacttctcattttggggagattgtgagagtgtttttgtgtgaaggatagtgacaacttattaattaaaattaataatattgggacatggatgaaattggaaatcatcattctcagtaaactatcgcaagaacaaaaaaccaaacaccacatattctcactcataggtgggaaatgaacaatgagaacacatggacacaggaaggggaacatcacactctggggactgttgtggggtggggggaggggggagggatagcattgggagatatacctaatgctagatgacgagttaatgggtgcagcacaccagcatggcacatgtatacatatgtaactaacctgcacattgtgcacatgtaccttaaaacttaaagtataataataattaataaaaaaattaataatattaaaatacaaagagttatttttgttggtgtatagaagtgaagatacatgtaaaaggatatatatgaatacttagtatccaaattggtatgctgtactggttattaatagtctctgagactcaggccacactgtgtgttatgctctgtgatgttgaggctcagattttgtaaaccacatttatgctctgcctgctacctccctggtagtctttgcctaaagaaggtgctagagcagtgtcagttcctgccagtagcagcagcttaatccagtttgcagtttccccagcatttccagaattagccttattgcacttcctcagatactccaccaccagttggcagtaccccctccccagaagtgttccattggaagaccctcctcaagtgcactcagatgagcatcatcaggcctgtgctccctcctaagaagtctgcatttcacatttgcaaagcctttcctccaaatttctgggatttaataatttcaaactcttccctttgttcccccctaggagtggtagctgcttcctgctgttaccatatccatggtaatttattgttttctttttgcatttttatttttccaatgcctagttaacaattctttatgttagtttcctctgctaaaacaattggtgtgttttctgtctcctgactggaacttgattgacacaagcaatttacaggcacaccagcagtgtaaaagcatgtcctttgttccacagtccttacaacagaaggaagtgttagtaattctcagggttgtttttttttttttttaatttagccattttcatgggtgtgtaaggtaaccccattgggttttaatttaaaatttccagaatatttataaagtcaagaaacttttttatttttaatggagtgtctgagtttcttattgggttgcctttttttctcaagtgggtatcccagccagcaccacttattgaaaagatcacccagctgggcgtagtagctcatgcttgtgatcctaacatgttgggaagccgaggcgggaggattgcttgagcccagatgttcaagaccagcctgggcaacatggcgagcccctgcctcctctaatatatatatatatatatatatatatatatatatatatatatatatatatatatatatatatatatatatatatatgtaaagttttaaaaaagaggaaagaaaatgtcaccctttctgtactgctctgcagtgccacctttgtaataaatccagtatccatatgtgtatgggcctgtttctgaactctccatcctattctaatggatttttttggtctattcttgcactatacatcaagtcctaattaaactagcttcaccatctttcctgctattctgtattacatcttcttcttcaaggatgatttggccatgtgcatttctacattaaagaatcagcttgtcaagtcgcaaaataaatctgtggaaattttggttgtgactaaacctgtagaacaatttggggagaacatctttgtcatattatgtctttaagcccatcaatacgatagtgctagatatcttctcatccagacccatcatcctttttcaccctaccctatgttccaggaatatggactacattaatgaaatcccttgccatatggcttctggttagatttggccagaaccccagaaggaaatcagaatgagagaggagggtgaggtcagagtatttatttctctgggtctctccttgaaagattgtcttgggttggcctcaactgaagctcactgcttatttcaaagcatctatctctacaggactcactccttttgggttctgacaactgcttcctccttttgtccctactggactaagcttggtaactgctactccactgctattatccctaggtcctatattaccctttgcgtttcctctacaatatatccatacatttataaatacttactttgaaaacaaaccctccagaattattctaattttaacaacagctttattaaaacataattgatatacaaagaactgcacatatttaatatgtataatttgatgtttgagtatatacaaatatccataatgccatcaccacaatcaatgtaataaatgcatcaaacactttcagtttccttgtgtccctttgggttttttggtttgtttgtggtaataacacttaacatgggatctaccctcttaacaaatttcgaagttgtagttaacaatctctgcttctgtgagtttgattattatagatttctcatataggagtatttgtccttatgtgactggctttcttcatttaatataatatcatccaggttcaaccatgttgtcacatatggcaagattttcttcctctttaaggctgaataatattctgctgtatgtatacaccacattttatttatccattcatctggacatttgaattgtttccatattttggctattatgaatactgctgcaatgaatgtgtgagtgcagatatcttttcaagatccttatttcaattattttgggtatatactcagaagtgggattgctggatcacatgatagttttatttttaagtttttgaggaaactctttagtgttttctatagctgctgcataatttcattttcccactaacagtatacaagggttccagttacttcatatcctcactaacatttgttatctttgggtttttgataatagccatcctaataaatatgaagtgatatctcattgtagttttgatttgtatttcactgataattaattatgttgggcatcttttcattatctgttggccatttgtatgtcttctttggagaaatgtctgttcaagtcctttgcccactttttaattgagttatttgtttttcactatcgagttgcaggagtttcttatatacagttgactttcagacaacacaggagttggggcaccaactccctgcacagttgaaaatctacatgtaacttttgactctccaaaaacttaaccagtaatagctccctgttgactggaagccttttcaataacaaagagttgattaacactatgttgtatgttaatgtattatatactgtattcttacaataaaataagctagagaaaaagtgttattaagaaaatcataagaaagagaaaataaatgtatagtactttactgtatttgtcaataccataagtgtacatcatctatttgcaagattaattgtctgtctgaaatggtgggcaaccacagctgcagacctcaatctatagaaaatatcaagcaactcaactttttttgataggggttgcattaaatctgtagattgctttgggtagtatgaacatattaataatactgttttttccaatctgtgaatatggaatatctttctatttttgtgtcctcttaaatttctttcatcagtgttttatagttttcatggtaaagatctttaatttctttggttaagttgattcctaggtatttcattttatttgtagctattgtaaatgggattactttcttaatttctttttcagatttttcactgggcatatagaaatggtactgatttttgtatgttgatattgtatcctgaaactttactgaatttgttttccagttataatagtttttttagtaaagtctttaggtttttccaagtttaatatcgtatcatctgcaaacaaggataatttgacttcttcctttccatttttgatgccttttatttctttctcttgtctgattgctctagctaggacttgcagtactatattgaataccagtagttaaagtgggcatgcttgtgttcctgattttagaggaaaggctttcagttttacccattcagtatgatactagctgtgggtatgttgtatatggcttttattatgttgagatatattccgtctatacccaattttttgaggattttaattatgatgaagtgttgaattttatcaagtgctttttcaatatcaattgaaatgaccatatggtttggtctttctgttgatatgatgtactgcattagttgatttgcctatattaaaccatctttgcatccgtgtgataaatcccacttggtcatgataaattatctttttaatgttttatagaatttggttttctagtatttggttgaaaaattttgcatcaatattcattagtgatattggcctatagttttcttttgtgatgttgtaacgccaaagattcttgccttagccacaccaaagaattgatgtggcggcagcccgcggtgagagagagacacggatcagactgagagaaaaaagctgtaggctttattgagcagagtggcagtacaaagcttccacagcgtggaaggggtcctgggccggtagccagtgttagattttttgatcaccctttaaaccctttaaggcgggaaatacgtgcggcgggaagatgttaccagagcgagaaacaaagacaattaacatgtatcagatcttgaggaaaaccggaattgtaacttaaggtttatctactttatgaccttgcagcggcatggcaaaggagacaggatctcacaggattttacaaactgtgtttacaaggaatcggaattgggagcatagataaggtttgctggtcacagaaaaacgggcttttaacattcctttcagtttcaggggagggggaagggagagagggagcgaggacacagggaagcttacagcaaaagtttcgctgtttatagctttcttggggaagaaaacacatgcacaaattctgatgttaggaatattttaagcatatatcttcaatattattcatccaggaccaaagtaagtcctgttgcagaaaatgagtttcatagctttctgagcccctgctagacccaggaagcccagctggcacctcctctcaatgtctttgtctggttttgatatcaaggtaatatggcctcagagaataagttcctcctcctccattatttggaatagtttgagttgttattggtctgttcaggttttggatatccttatcactcaatcttagtaggttgtatatgtctagaaatttatcaatttcttcaagattttccaatttattggcatatagttgctcatagtagccactaaaaatccttcaaacgtctatcagttgtaatgtctcctttttatcccttattttatttatttgggtcttctctttttttcttaattagtctgcctaaaggtttgtgaattttgtttatctttccaaaaaaccattttttgtttctttttttatattgttttcttcatttcaaatttgtttctttatcctcacatttttattatttcttttcttctactaatttggggtatggtttactcttgcttttctagttgtttaagattgattattagattgtttatttgaaattcttcttttttaatgtaggcacttatagctataaacttcccacttaggactgcttttactgtatcttataggttttagtatgttgtgtttccattatcatttgtttcaagaaatttttcaatttccttcttaatttcttcattgactcactggtcatttaagagcatatttttaaatttccatgtatgtgtatagtttccaaaattcttcttgttgttgatatctagttttattccactgtggtcagggaagatgcttggtattatttcaattttttgcatcttttaagatttattttgtgatctaagatatggtttatctttgataatgtcccatgtgctgaggagaggaatgtgtattctgcagctattggatgaaatgttctgtacaaatctattaggtccatttggtctatagtgcagattaagtctaatgtttctttgttgattttctgtctgggagatctgtccaatgctgaaagttgtgtgttgaagtctccagctattattgtattgggatctctctctctttagctctaaaatattttctttatatatctgggtgctccagtattgggtgcatatgtatttacaatcattatatcctctcactgaattgacccctttatcattatatagtgaccttccttgtctcttcatatagtttttgtcttgaaatcaattttgtctgatgtaagtgtaactactcctgctctttttttggcatggaatgtttttctatccctttatttttagtctgtgtgtgtctgtaagtgaagcgtgtttcttgtaggcagcatattattgggtgttgtttttattcattcagctactctgtgtcttttgattggagagtttagtccatctacatttactgttattattgataagtaaggacttactactgccatattgttatttgttttctagttgttttgtagtcttttctctcgtcttaacttccttcctttctttcttttagtgaaggtgatttttttttctgctggtattatttaatttctcactttttaatgtgtccattgtatggttttgtatttgaggttaccatgaggcttgaaaatactgtcttataatccattttttaagctaataacaacttaacattgtttgcataaacaaaaaagtgaaaggaaaactaataaaagctctacactttaactttattcccctgcttttaaattttttgttgtttctatttctatcttcttcctttcttccttatacctttaaaagttgttgcagttattattttccattggttcatcttttgatctttctacttaagataggacttgtttacataccacagttacagtgttgtaatattttgtgttttttctgtgtacttactattaccaatgagttttgaaccttccaatgatttcttattgttcactaacgtccttttctttctgcttgaagtactccctttaacatttcttgtcgggcaagtctggtgtggatgaaatccctgagcttttgtttgtctgggaaagttattatttctctttcaagcttgaatgatatttttgccagatatactattctagggtgaaaatattttttccttctcacacaaatggagtctctctttctgttctgagtcttctggagctggggatggcatcccatgagcaccccagtggttaccaccacagagactacactgcatcagacctgaagccagcacagcaatgggtcttgcccaaggcctgctgtaaccactacctacctggctactgtgtatgtttgttcaagaccctggggctccacaatcagaagatggcaaagccagccagccctgtgtttttcctttcagggcagtgcgttccaccaggccccaggcaggtcccgaggtaccatccaggagccaggtattggcatcaaagtctgtccaattctacctggtgttctattgtactgtgtctgaccccgcactcaacccataagtcacaatgcttcccactcttccctctcctttccataggcagaggagcctcaccttatggccaccagcacaggcccacagggagtactgccaggctactactgatgttcccttaaggaccaagggctcttcagtcagcttgtggtgagtgctgtctcaccttagattcacccttcaggaatgtgggctcccctctggcccagggcaggtccagaaatacatccaagagccaaggcctagaatcagggaccccaagagtccacttggtgctgtatcgttctgtggctgaactgatacctaaggtgcaagacaagtcccctttacttttctctccacttttctcaagcagaggaatcacttcccgtagccaccacagctgaaaatgtgctgagtcttacttgaagcccacaagtctcagagtctcacccaatgcccatatactacctaggtatctctgctggttattcaggacccaagggctcttcagtcatcaggtgatggatcctgccaggactgggtccttctcttcaatgcagcaagttcccttctgtcccagcgtttgtctagaaatgtcatctgggagttagggcctcacaactctgactggtgcactatcctactatggctgaactggtattcaagatgcaagacaacatcctctttactttccctctcttcttttcaagtagatgaaaggggtctcctctggaggcacaaactgtactgcctcaggttacaaacactcctttagctgccgcagctggtatctcactaggctgtgtgtcaccaagtacagtgtctatgagcccatttcaacactaggagtcacctaggagttacagtccttgtggcctaggtgacctttcagatttatttatgttccccagagcacttcagcccatgctggtgaggctttccagtactcaagttctgactactgggatgggtgattcctttctagctaggcctggtttaagtactctactctctccatgggcgagcatcagctgaattcaacctagttttgctttctgctgtgacagggcagcactgagttcaatgcaatgtctcacagttgttgcacttttcttctcccaaatgcacagattctctctctgcaccacatggccactgccagagggttgggggaagggtggtatcagtgactcaagactgtctttcctattctctttagtgcctctttcagtgatttgaagttaaaggcaagtactctgagtgctcacctgatttttggttcttatgaaggtgcttctttgtgtgcaggtaattgttaaattggtgtccttgtggaggggatgattagtggggccttctgtttagccatcttgtccctcccctctccagattcactcttctgtttaagttttcaatccatttttaattgacctttgtgtttcatgtaagataagggtccaattttattttttctgtatgtggatatccagctttcccactaccatttgttgaaaaaactattcttcccttattaggtaattttggcacacttttcaaacatcagttaatcgactgtatgtgcatgtgtttatttctgggcttcttatcctgttgcattgggctatatgtctgttcctatgccagtactctctagttactgtagctttgtaacatgtctcgaaatcagaaagtttgatgcctctagatttgttctttctgaagatttcttgggctattccagatagttttgtgttctcatctaaactttaggattgtttgttctatttctgtaaaaaatgttattgtgatttttatggggatagcattgaatctgtagatagctttgcatggtatagatattttaacaatattaaaatttccaatccatgaagtgtctttacatttatttgtgtcttcttttatttctttcaacaatgttttctagttttcagtgtacaagacttttgcctccttaattacatttatccctaagtacttttttttctttttaataccatcataattgtaatgggattattttcttagtttccttttttggatggtttgttcttagtgtgtagaaatgtaacttttttgtttattgattttgtatcctgcaactttacttaatttcttagttctaacagttttttgtgatgccttcagggttttctacatgtagaactatgtaatctgctaacaggaatagtttttcttcctttcctactcagcttctttttatttcctttaattctttttcttgcttaattgctctgggtaagatttccaccactattttggatacaagtggtgggagtgattatccttgtcttgtttctgatcatagaggaaaaaaagtcagtctttcactattaagtatgataccatctgtgagcttgtcatatatagcctttattatgtgaaggtacatttttttctccacctagtgtgttgagcattgttatcatgaaggagtgtggaattttgtcaagtgctttttctgcctctgttgagatgatcgtatatttttttaatccttcatgctgtccacatagttttgttcaagtccaatgtttcccttttgattttctatctggatgtttatccattgctgaatatgggaattgaagtctcctacttttattgtattgtctctatttctcccttcagttctgttaatatctggtttgtatatttagttgctccaatttggagtgcatatatgtttacaattgttatatcttcttcttctttcttttttttttacattgtattttgttttttgttattattatactttaagttctggtatacatgtgcagaatgtgcaggtttgttacataggtatacatgtgccatggtggtttgctgtaccaatcaacatgtcatctacattaggtatttctccaaatgctatccctccccttgcccccaccccctgacaggccccagtgtgtgatgttccccaccctgtgcccatatggtctcattgctcaactcccacttatgagtgagaacatgcagtgtttggttttctgttcctgtgttagtttgctgagaatgatggcttccagcttcatccatgtccctgcaaaggacatgaactcattcttttttatggctgcatactattccatggtgtatgtgtgccacattttcttaatccagtctatcattgatgggtatttgggttggttccaagtctttgctattgtgaatagcgctgcattaaacatatgtgtgcatgtgtctttatagtagaatgatttataattttttggtatatacccagtaataggatggctggttcaaatggtgtttctggttctagatcattgagaaattgccacactgtcttccacaatggtcgaactaattaccctcccaccaacagtgtaaaagtgttcctatttctccacatcctctccagcatctgttgtttcctgactttttaatgatcgccattctaactggcatgagatggtatctcattgtggttttgatttgtatttctctaatgagtagtgatgatgagctttttttatatgtttgttagcctcataaatgtcttcttttgaaaagtgtctgttcatatcctttgcccaatttcgatagggttgtttttttcttgcaaatttgtttaagttccttgtagattctggattttagccctttgtcagatggatagattgcaaacattttctctcattctgtaggttgctggttcactctgatgatagtttctttcgctatgcagaagctctttagtttaattagatcccatttgtcaatgttggcttttgttaccgttgcttttggtgttttagtcatgaagtcttggcccatgcctatgtcctgaatggtattgcctaggttttcttctagagtttttatggttttagtcttacatttaagtctttaatccctcttgagttaatttttgtataatgtgtaaggaaggggtccagtttcagttttctgcatatggctagccagttttcccaacaccatttattaaatagggaatcctttccccattgcttgtttttgtcaggtttgtcaaagatcagatggttgtagatgtgtggtgttatttctgaggcctctgttctgctccattggtctatatatctgttttggtaccagtaccatgctattttggttactgtagccttctagtatagtttgaagtcagatagcatgatgcctccagctttagaagataagaagtaactaagatcagagtagaactgaaggaaatagagacatgaaaaagccttcaaaaaaatcagtgaatccaggcgctggttttttgaaaagattaacaaaatagaccactagccagactaataaagaagaaaagagagaagaatcaaatagacaaaatgaaaaatgataaaggggagatcaccactgatccaacagaaatacaaactaccatcagagaatactataaacacctctatgcaaataaactagaaaatctagaagaaatggatacattcctgaacacatacaccttcccaagactaaaccaggaagaagtcgaatcactgaatagaccaataacaagttctgaagttgaggcataattaaatagcctaccaaccaaaaaaagcccaggaccagacagattcacagccgaattctaccagaggtacaaagaggaactggtaccattccttttgaaactattccaaacaatagaaaaagagggactcttccctaactcattttatgatgccagcatcatcctgataccaaaacttggcagagacacaacaaaaaaagaaaatttcaggccagtatctttgatgaacatcaatgtaaaaatcctcaataaaatactggcaaaccaaatccagcagcatgtcaaaaagcttatccaccacaatcaagtaggcttcatccctgggatgcaagactagttcaacatacgcaaatcaataaatgtaatccatcacataaacagaaccaattacaaaaaccacatgattatctcaatagatgcagaaaaagccttcaataaaattcaacaccccttcatgctaaaaaccctcaataaactagatattgatggaacatatctcaaaataataagacctatttatggcaaacccacagccaatatcatactaaatgggcaagagctggaagcattccctttgaaaatcggcacaagacaaggatgccctctctcaccactcctattcaacatagtattggaagtccggccagggtaatcacacaagagaaggaaataaagggtattcaaataggaagggaggaagtcaaattatctctgtttgcacatgacatgactttatatttagaaaaccccatcgtctcagcccaaaaactccttaagctgataagcaacttcagcaggctcaggatacaaaatcaatgtgcaaaaatcacaagcattcctatataccaataatagagagccaaatcatgagtgaactcccattcacaattgctaaaaagagaataaaatacctaggaatacaacttacaggggatgtgaaggacctcttcaaggagaactacaaatcactgctcgaggaaataagagaggacacaatcaaatggaaaaacattccatgctcatggataggaagaatcaatatcgtgaaaatggccatactgctcatagtaatttatagattcaatgctatcctcattaagctaccattgactttcctcacagaattagaaaaaattattttaaatttcatatggaatcaaaatagagcccgtatagccaagacaatcctaagcaaacaaaactatgatatattgttatagtcctttagttcagtgtgttgttaagtactcatggttatttcttctttaattttttaattactttggaagcttcttgcttaaatttcaaatgtagatttttagcgatttttaattttgagctcaatagaattataaattgatttatgacccagcatatgctcaacttttatagatgttttatatgtatctgaaagctatacgtgttctgcagtaattggatgcagcgttctatatatgtcaattagatcaagtttattaattgggtttttcaagtcctctacatattgaattttttgtacatttgtgcagcagccgtgtggtgtaccaccttgctctcccttcaggaaagtacctccacagtaggtgcatttagctgaaagccttcagctgcagcagtttggggatctgacatgcggtttgatggagtgccaaattcttgctggaaagttcccagacaaaaactgagcactatgaagatactagaccttggctatttctacccaatgcagcattcttctacagtcacttaagtacagaattcttcaatagcatcatttttcatttctctgagataaattctcaagagcacagtttcaggggcatgtggtaattacatttttatttttctaagaaaacacaaagctgttttccatagagaatgtactattttatattcccaccaacaatgtatcagtgatccagtttctctgcatcctaaccaccattgatgttatcactttttttttttttttgaaacagagtcttactctgttttccagactggagtgcagtggtgcaatcttggctcacggcagcctccacctcctgggttcaagagatcctcatgcctcagcctcctgggattacaggcatacactaccacacccggctaatttttgtatttttagtagagacggggtttcaccaggctggtcttaaactcttggtctcgagtgatctgcccacctcagcctcccaaagtgctgggattacaggcatgagccagctcacccagcccaggtatttttaagtttagacattctggtaggtttataggggtatctcattgtgcttttaatttgcagttccccctggtggctaatgatgtattttctcttttcatggccttatttgcaatttgcatactcctttcaatgaaatgtctatatcttttgtccatttcctaattattgaattttgaattttaaaaatatgttctagatactagtcctagatttacaaatatcccagtctgttgcttgtcattttatccttagagtttttgcagagcaaaaggctttaaaattctgatgaggtctaacttaccaattttcattttatgtatcatgcttttaacattttttattttaattttatgggtacatagtatatgtatatatttatggggtacatgagatgtttcaatataggcatgcaatgcataataatcatatcatgtaaaatggggtatccattccctcaagcatttatcctttgtgttcatattagtccattctcgcattgttataaagaactacctgagactgggtaacttataaagaaaagaggtttaaaattggctcacatttccacaggctgtacaggaagcatggctggggaagcctcaggaaacttacaatcatggcagaaggcagaggggaagcaggaacgtcctacatggctggagcagaaggaagagagcaaacagggaggtagaggtgctacacacttttaaacaacgagatctcatgagaactcaccatcaggagaacagcgaggaggaaatctgcccccatgatccaataatctcccactaggcccctcctccaacattggggattacaatttgacattagatttgggcggggacacaaatccaaaccatatcagtgttataaacaatccaattacactcttttagttattttaaaatgtacaattaaattattattgactatagtcacactgttgtgctatcaaatactaggtctgattcattctttctaactattttttttttatccattaactatccccaccttccttcaccccagcccattacaacctttcccagtctctggtagccatccttctactctctatctccatgaattcagtcgttttgacttttagatcccacaaataagtaagaacacacaatgttttgtctttcttgcctgccttatttcatgttgcaaatgacaggacctgttttatttctttttatggctgaatagtattccattgtgtgtatatataccacatttcatttatacatttatctattaagggacactcgggttgttaccactgttgggctactgtgaatagtgtttctatgaacatttgtgagcatatttttggttggatatttgtttttgagtctcttgagtaaatatcttggagtggaattgctggatgatatagtaactttatgtgtaagcttttgagtaacttccagaatgttttttgccatgattgcacaattttaaattctcgttgatggttcagtttatctacattctcaccaacatttgttattttctgccattattgttattattagcatcctaatgggtgtgaagtgatatctaattgttgttttgatttgcatttccccagtgattaatattgagcctcttttcatgtgcttactggccatttgcatatctcctttagagaaatgtctattcaagtcatttgctcatttttaaattgggttgcttttctcattattattgagttgtaggagttactcatatattctgaacactagatccttatctagttatcagatatatggacccttatctagttatcagatatatgatttgcaaatatgttctctcattctgtcttttcacctcttaataatgtcttttgatgcactaaggttttgaattttgatgaagtccattttatggtttttaaaattttgttacttgtgcttttggtgccatatctaagaaaccattgcctgattcaacatcatgatttattcccaagttttcttctaatattggtacagttttagctcttatatttaggtctttgaactattttgagttaatttttatacataatgttaggtaaaggtccaacttcattcttttgcatgtggatatccagttttcccagaaccatttgttgaagagactgttctttccccattgtatggtcttggcatcctggttgaaaatcaattatacatagatgtttgggtttatttctggattctcaattccatttcagtgatttatagatgccattgtctatccttatgctagtgccacattgtttggattactgtagtgttataataagttttgaaattggaaagtgtgagtcttccaactttttattttgttttctaaattgatttggctacttggactcattgcaattccatatgaattttagtattgtcatttccatatctatagaaaaggttattgggactttacatataataggaaaaccaactgtttttcctactctcatgcttagcacagaccacttctggtcaccaaattacatatggggatttctccacaccaacaatctattctcctgtggacacccacttggtgtcctataattaaattaaattatgacaccatctgcctggaaacaatgtcagatcccacaggttaagggctcaaccctgcaatactgtgtatattcagatgccagttataagtagtagcttgtcacctatacttctgacaactagctataaatcaggattcctttgacctttccctcagtttagattaatttgctaatatggctcataaaactgagtctatatatttaaagtgggtttgttgtagacaacatgtagttggattttattaaaaacctacattggcaatctttttttgaattggtgcatttagatcatttatatttaaagtggttattgatttttaaaatgtatatctaccatatttggtaactattttctgttgctttttacatttttaaaatttttatagatttaggagatagaagtgccatatttttgttatgtggatatattacataatgataaagtctggatttttggtttactcatcacctgaatagtggctcttatatccttaggtaatttttcaaccctcaccccctcctactatcccaccttttagaatctccagtgtctactatttcactctgtatgtccatgtgtactcatttttacttcccacttacaagtgagaacatgcagttttcaactttctgtttctgagctacttcacttaggataatgacctccagttccatccatgcaactgcaaaagacatgatttcattctttcttatggctgcatagtattccatggtgtgtgtgtgtgtgtgtgtgtgtgtgtgtgtgtgtgtgtgtgtgtgtataatataaaatcttctttatctaatcatctgtttatgcacacttaggttgattccatgactttgctattgtgaatagtgctgcaataaacatataagtgcaagtatccttttaattaatgatttcttttccattgggtagatactcaatagtgagattgctagattgaatggtagttctatttttcgttctttgagaatccccacactgttttctgtagaggttgtattaatttacatttccatcaacaatgtataagcataccctttcctctaaatccttgccaacatctgttgtttttttgactttttagtaatagccattctgactggtatacaatgatatctcattggggttttaatttgcatttctctgatgattagtgatgttgagcatgatttcatatatttgttggctgtacgtcttcttttgaaaaatgtctgttgtgtcctttggccatttttaatggggttatttgggatttttttcttgttgagttgtttgagtttcttgtagattctggatattagccttttgttagatgcatagtttgaaaatattttcttccattctataggttttctgtttactctgctgattcttttgctgtgcagaagctttttagtttcattcccatttgtctattttttgttttgtttcatttgattttggggacttagtcataaattctttgtctatgccaaagtctaaagagttttcataggtgttcttctaggattttttatagtttaaggtcttaaatttaagtatttactccgttttgagttaatttttgtatatggtgagagatatgggtccaggttcattcttctgcgtatgatgattaaatagtcccagcaccatatattgaatagactgacctttccccagtgtgtatttttgttggttgtggatacgtggctttatttctggattctcaattctcttccattgacctatgtgtccatttttataccactaccgtgctgtttttgcagtgactggtaccggtttttcctttccatatttagtgcttccttccagagctcttgtaaggcaggcctggtggtgacagaatccctcagcatttccttgtctgtaaaggattttatttctgcttcacttatgaaacttagtttggctggatatgaaattctgggttgaaaattattttctttaagaatgttgaatattggcccccactctcttctggcttgttgcatttctccagagacattcactgatgggcttccctatgtaggtaacctgacctttctctctggctgcccttaacattttttcctgggtttcaaccttggggaatctgacaattatgtgtcttggggttgctcttcttgaggaatatcttagtggtgttctctgtatttcctgaatttgaatgttggcctatcttgctaggttggggaagttctcctggataatatactgaagggtgttttccaacttggttccattcttcccatcactttcagggaccccaatcaatcagaggtttagtcttttcacatagtcccatatttcttggaggctttgtttgctcctttttaatctttttttctctaatcttgtcttcatgcctcatttagtaagttgatcttcaatctctgatattctttcttccgcttgattgattcagctgttgatacttatgtatgcttcaaaagttcttgtgctgtgtttttcagctccatcaggtcatttatattctttaaactggttattctagttagcagttcctgtaaccttttgtcaacgttcttagcttccttgcattgggtttgaacatgctcctttagctcagaggagtttgttattactgaccttctgaagcctacttctgtcaattcgtcaaactcattctctgtccagttttgtgcccttgctggagaggaattgcagtcatttggaggagaagaagcattctggtttttggaattttcagcctttttacgctggtttttttctcatcctcatggatttatctacctttgatctttgagattgatgacctttggatggagtttctgtgtgggcattctttttgttgatgttgatgttattgctttctgtttgttagtttttcttctaacagtcaggcccctcttctgcaggtctgctgcagtttcctggaggtccactccataccctattttcatggatatcaccagtggaggctgcagaacagcaaagattgctgcctgttccttcctctggaagctttgtcccagagggtcaccgacctgatgccagccagagctctcctgtatgaggtatctgtcaacccctcttggaaggtctctcccagtcaggaggcacgtgggtcagggacccacatgaggaggcagtctgtcccttagcagagctcgagcactgtgctgggggaaccctccttgtcaggatctgctgctctcttcagagctggcaggcgggaatgtttaagtctgctgaagctacacccactgccaccccttcccccaggtgctctgtctcagggagatgggagttttatctataagcccctcactggagctgctacctttctttcagagatgccctgcctagtgaagaggaatctagagaggcagtctggccacagccgctttgccatgctgtgttgagttctgcctagtctgaatttctaggcctttttagtgtggtcaggggaaaactgcctactcaaacctcagtaatggcagatgccccccgctaccaagctcaatctttccaggtcaacctcagactgctgtgctagcagcaagaatttcaagccattagttcttagcttgctgggctccacggaagtgggacccgctgagtgagaccacttggctccctggcttcagccccctttccaggggagtgaatggttctgtctccctggggttccaggcgccactgggcaggggaggaggatgggaaactcctgcagctagctcagtgtctgcccgaacagccgcccagttttgtgcttgaaacccagagccctggtggtgtaggcacatgagggaatcgcctggtctgcagattgcaaaaaccgtgggaaaagcatagtatctgggctggatatcacagtccctcatggcttcccttggctaggggagggagttccccaaccccttgcactttctgggtgaggtcatgccccaccctggttctgctcaccctccgtgggctgcacccgctgcctaaccagttccaatgagatgaataatgtacctcagttggaaatgcagaaatcacctgccttctgcattggtctcactgggagctgcagactggagctgttcctatttggccttcttgccagcagaatctactgtgccgttttggttgctatagccttgtagcataattttcacttgggtaatgtgatactttcagcttggttctttttgcttaggattgctttggctatttgggctcttttttggttccatatgtactttataatttttttttctaattctgtggaaaatgacgttggtaacttgataggaattacattgattctgtagattgggcagtatagtcattttaacaatattgattctttcaattcatgcacatgagttatcttccatttaattgtgtcatctatgatttctttcatcagtgttttgtagttcgctttgtaaggatgttttacctccttgattaaatacattcctaggtattttaatgtttgtagctattgcaaatgacattgagttcttgatttagcgctctgcttgatactgtttggtgtatagaaatgctactgatttttgtacattgattttgtagccttaaactttactgaagtcatctttaaatctaggagtctcttgaaagagtctttagtgttttctaggtatgagatcatatgatcagtaaacagagataatttgacttcctctcttccaatttggatgacttttattcatttctcttgcctttttgctctagctaagacttccagtagtatgctcaatagggagtggtaaaaatgggcatccttgacttcttcctgttcttagggggaatactttcaacttttacccattcggtatgatgttggctatgggtttattatatatggctttaattattttgaggtgtgttcctttgatgcctagcttgttgagggttttatcatgaaagggtactaaattttatcaaatgcttttttgcatctatctagatgatcatatggttattgtttttaattctatatatgtggtgaatcacatttattaatttgcatgtgttgaaccacccttgtatccctggaataaggagcacttgattgtgatgtattatctttttgaagtgttgttggattccttttgctagggttctttttttctttcttctttctttctttctttctttctttctttctttctttctttctttctttctttttttgagacagagtctcgctctgtcgcccaggctgaagtgcagtggcacaatcttggctcactgcaagctccgcctcctgggttcacaccattctactgcctcagcctcccaagtagctgggactacaggtgtctgccaccacgcctggctaattttttgtattttttagtagagacggggtttcaccatgttagccaggatggtctcgatctcatgacctcgtgatccgcccgccttggcctcctaaagtgctgggattacagacgtgcgccaccacacccagcctttattttttgaggatttttgcacctatgttcatcagggatattggcttgtagttttcccttttcattgtgtccttactctgctttggtgtcagggtgatgatggctttatagaatgaattaggaaggattccttcctctttgatttttggaaactatttcagtaagattggtgccattccttctttgtgcatctggtagaaattagctgtgaatccagccttttttgagggaaagatttttatgactgattcatcttcactactggttgttggtctgttcacattttctaccttgtagttcaatctttggaggttgcatgtttctggaaatatatccatttcctctaggttttctagtttgtatgcatagagatgtttatagtagtctctgatgatcttttgtatttaagtgatatcaattgtaatgtcacttttatcatttctgattgtccttatttgtatcttctctctttttttcctggataatctagctagcagtccatcaattttgcttattttgttaaagaaccaacttttaattttatagattctttgtataattttttggtttcaatttcatttagttctgctatgatctctgttatttcttttcttctgctagctttggatttggtttgttgtttttctagtttcttgaggtgtgacattaggttgttaattagaggcctttctatcttttgaatgtaggcatttaatactataaactcccccttagcggtgtttttgctgtatcccaggatctttggttcattgtgtctgtattttcatttgtttcaaaattttcaaatttccaccataatatcatcatctacccacagattattcaggagcagattgtttaattttcatttacttgaatagttttgagacttcctcttggtgttgatttctagttatattccattgcggtctgagaagatatttaacaggattttgatttttcaaatttattgagactggctttgtggcctagcatatggtctatttgggagaaagttctagatgtagatgagaagaatgtatatactgctgttgttaggtggaatgttctataaatgtctgttgggtctattttatcttgagtccaatttaattccagagtttctttgttgattttctgcctcggtgatctgtctagtgctttcaatgaggtgttgaattgctgtctattgcattgctgtctatctcttttcttaggtctagtagtattcatttttataaatctgagtgttccagtgttgtgtgcatatctatctaggattgtcatatcttcttgttgatttgattcctttatcatatatatactgaccttctttgtcttttttttttttactgttgctagttaaaagtctgttttatctgacataagtagaggtgctcctgctcgcttttggtcctgtttgcatggagtatctttttccacttctttacttcaagtctgtaaatatcttaccagttaggtggattcttttgtaagcagcatatttttggatcttgtttctttaaatccattccactagtcaatatcttttaagtggagcatttattccatttgctttcaagattaatattgatatatgaggttttgtttctgtaataattttaattgttatataggtgttttttagtctcgattgtgtaattgctttataagaactatgtgttttatactttttgtgtgttcttatgatggtggatatcattcttttgtttccttgttgaaaattcctttcagcatttcttgtaggactggtctagcggtgacaaatttctttagcctttacttgtctgggaaatactttatttcttcttcatttatgaagcttagtttagtgggacacaaaattcttgactggcagttttctctttaagaagactgaaaataggaccccattctcttatggcttataagggttctgctgagaagtctggtgttagtctgatgggatttccttcataggtgattagatgcttctcccttgctgcttttagtattttttctttcactttgactttggctagtctgaagactatatggcttggtgaaggtcatcctgtagtctgtcttccaggaattctttaagattatcgtatctggatgtataaatctctaacaagaccaggcatttttttttctgaattatttcctcaataggttttccaaactttttactttttcttcttctccatcaggaatatctatgaccttgtatggttggtcactttacataatgccatatatttcaaaggctttcttcatttttttaaaacttttttctttatttctgtctaagtaggttaattcaaaagacctgtcttcaagctctgaaattctttcatctgctttgtttagtctattgttaaagctttcaactatattttggaacttctccaatgaatttttcatttccagtagttctgtatgggtttttaaaaaaattttctgtctctttagtaaatttctatttatatcctgaattatttttctgatttctttctgttcttttcaactttctcttgatttccactgggtttccttaaaattcatacttttaattctttatttgccattgcagaattttcattttgactagaatccattgctagagagctagtgtgattctttggggttgttgaaacacttcattttttatactaccagagttcttacactggttccttcttatctggataagctgtcacttctcatttttgaatttattttcatttggatgagactttttgtttccccccacccccttgagtgtgtgactgtagtgtatgttcagtagagtcatttggcaatttttctgagtgctttcaggggaacaggactctgtacgaatgccagggatataaataggcttaatgtggtggttttctgaaatgctgattatctgattatagtagtggtgtactggggatgtgaacaagctcactgcctactgtagagatagggacttggaggtctcaggaagcttatctcattctccggcacaagcattttgtcaacaggcattgtattgggttgtgcagctttacttccaggccagtaggtggtgcttgcagataaaagccagctgagcaatgtgcagttgtgttagctgaagttgtaatggtctgtacaagttgactagaaataaggccttggacctttggaaggcatataattggatttctaaaagacctgcttgccatgtgaaagtgtagtttggcaaaaaaaaaaaaaaaaaaaaactctaccaccaacagaatagttatgcattcaaagaaattttctggctatggactataaataggtcttaactaggatgtgggttcaaatgcctgtaagggagatcaaaagtggatataaacgtggaaaagtggaagaagttcagcacagggtacactggtgacatcacctaattccccaagaaatgttcagttctgaaaagctctggatagaagtggccatttcagctggccactactgcacttcttttgccaaggagctgcttacctatgagcaccagatttctaagtatacataaaaaggctatttgtgtgtatttgtttaatgtagtattagagttcttccagaagaaaagcttcagaaaaaaactgctcagagaaatgtgcaaagattgtgatgtaggaaaactacttataaatgagatggataagcaacagcataccaaagattttacatccaaccaagttaaaagacaagctgtaatgaatatgcaagaactcaagaaatattgtcattattccttcctaagggatttaatagaggacaagcttcaaataagcaagaaactataggagaagcttgggacatttctaatggtgagcagtaactatatttacctgtaaagctaagaataaataatggggatggaatgacagaatagagttaaacattatatggtctgaaatataaatatactacaaataataaaaatggctatagaaagaggatagccttgtaaatattaactgggagtaaaaggatataggtttaaatcagaggctaggtcagaaagagaggaaaggcaaaaagaggttaccagcaaatttcattatgactcatgaggggaaacaatagacagtttctttaaaatggagctaaaagcattatataaagatattagcatgaaataataactcttcaaatgttgtactagaccactatcatcagcatctcttggaaagttgttagaaatacaaattctcataccctactccagaaccgttgaatcagaaattttggaattggggcccagcaatgtgttgtaacagctctctaggagattctgaggtatgctaaaagtttgaaaaccactagaatcaagatatcattagagcaaaaatacaatttttctaaatagcaaaagatagaccaaaattaaaaaccaatgcaaacacagtgaattatttatgggtataagacacatacacatacaatatgcaagaatggacaccccctgctcccatagctactatttttttaatttttaatttttgtaggtacatagtaggggatttatatttatggggtacataagatgtttagatacaggcacgcaatgcataataatcacatcatggaagatggagtatccatcccctcaagcatttataagggcaacaaaaattacaaagtgtatagaaataactcttataaaatgcaataatttaaaagtgtttcctcttgaagaagaaaatgataaaactttaattacaatctattttaaaggcctaaatgaacgtagagttatactatgttcctgagggaaagatttgtgaacataaatgattattctcaagttattccatacattaaatgaaagtttaatcaagatatcaacaataaatatggattaaggatattattcttacagaacttgacatactgatactaaaattcatataaaattgaaaataggtaataatgatcatgactattttgaggaataagcatgaagaactgacattactagatagtgaaacttaccataaagccataatatttttaaaaagtgtaatattatagcataaatagacaaataaatggtggagaatcacaatgaacttacaaatatacaagaataaatgattagtatatgacatatagagtatataataaatcagtgtatgaaatgatggactttccaataaatggtgttaggatatttggttacccttatggaaacagataaaattagatcaatactttacacaatttataaaaatttaataatttaatttctggcaggtttaaaccctaagtaaaaataataagaagagtagaatacatatgtttgtggggtgcgtgtgtgtgtgtgtttgtgtattagtaagaagaaagtaagaaaaaagagaacagtaggaagtctttatgatatctagatgggaggagttctttaataaaacataaaaacacaagccataaagggaaagataaatttaaatatattaaaatttaaaatatttcagtataagcaaaggtaaaggcaagttacagactgacagaagatatttacaactcacaaatgacaaacgtttaaaattctgaatatataaagaatttctataaacaaaaaaagacaaataaccaaatcaaaaatatagatataatatgaatcagcagttactagaggaaggatcttgaatgactagtaaacatgttaaaagaaaatcaacctcacagaggttgcatcacaatgagatattatttaatattcaccggattggcaaaatttactctgataacaccaactttgggagaaatgaggagaaataggagcttttcattgttactaattgtaaattggtataactgctttagaaagaatttagcaatatctaataaatatagagatatacatacccacttctaggcctatagtcttgaaaattgtacatatgcattaggagatatggtgaaggatgttcattgcaaacgatttgaatagataaagattggaatgtacttaactacccatcatcagagaaatgaagaaaaaagctagcatggttcatttattcaatagaatactatgaagtcgttatgtggatgaactagatcaatgtgtaccaatatagataaatcttaaaatcataacattgaggggggaaaaagcaagatgcaaaaggtatgtacagtatgaaacacttgatccccaaattttaagcatgaaatcaatcaaatacatcttaatggatacgtacacatttagtgaaagtacaaaaacaagtattgggatgatacatgccaacttcaggctagtggtcatctatcagtgagaagtgggggatgaaggaatggaggtagggtttatctctatctgtaatgttttatttttttaagtgatataaagtaaaattaacaaaaatttggtgtccgtttaatctcaatagtggatatataggtgctttttaaattttctgtatgtttgaaatatttcataattacaattttaaaatttaaaaatcactgggatattacagatgtgcaaattgattatatggtggtgtgaattcttggacaattgaagaaggcttccctaataaaatacatttaagctgaatcctgaaatatgagtaaaatccatctgaaggttggtggggtacaccatttccagctgaaggatcagcaagtgcaaaggctctgaggtatgaacatggttgggctgttcaaggagaatcaaggagggaaatgtaactggaggagactgatcaatgagatgaacaattggagattagggcacagaagtagcagggagccaggtcatgcaagtattttgttgttttaaaatattttatttatttttaattgataataattgtgtatatttatgggatagatcatgcaaatatttaaaccagggtaagaactgaattaacctgaatttgatggagccatttgagggttttaaatgaaataatgacttgaactgggttgtgtttttaaaacactgctctgactacaacgctgagagttgtcctataggccagttaggagctataatccaaaaaagagataatatgggcttagaccaagttgataacaatggggaagcagaagcgtaaacagatttttggcaaggagtgaaagagagtgctaagaatcaaagaagactcccaggtttccgacttgagagttgatcattgatctatattgctaacaatggtaacaacggaggtaaaatatatttgtgttgaacgtgtgggatgaaaatgatgagcttattttggatttatacatgtttaaagcttaggagagaggactggaatggaaatatggacctggaagactttgcaatttggatgattaaagccttgggagtgggtgaaattacttaggagctaatggaagttaggagagaggctggaatagagctttgaggaggttcaatatttaatggcttggtggaagtggagtagccagcaaaggatactgataaggagctgcaagataagcagaaggaaaaccaagagactgtggtgtactatacttaaagatagagtgttttgtatagcatgtggtggtcaagtctgtcaactaccactacgaaatccagcaaaacgagattttataagtgtaaaatacatttagtgatattgaagtcattagtgatctttgtagagagatggggtggaaatcagacttgagagggttaagtagtgagtagaaataaagaaaagaacagataaaatgaacaaaacaaagtaaggacaattcttttgaaaaaattggctgtgaatggggtgggaagggatacagtaggaggatgagaagtcaagggggcattttgtttgttgttttcttaaaagtgggagaaaaatggaaatgcttaaatgctgatgtgaaggagccatttcagggaacagtctgaagatacaggacaaatagggggaaattggtaatgtctgggactccaaatggtaagagtgaatggaattcaaagcatagaggaagagattggccttaactaggagaaaggacaacccctctactataataagttgaaaggaagatagaataggcacagaggcagaaagtgtagggttggtggcaagaaaatgaggaaactcctatctggtgccttttgttatacctataaagtaggaagtaagtttgactgctagggagatggtggtagtgatggtggtgggtgtgtgtagtagttcttttcatcaaaacataccattaatagagagaaaaggcaagtcacagagtagaagataattacaatacatacatttgacaaaggacttgtgttcagaatatataaagatctcttatgaatcaataagaaaggacaatagcctaattaaaaatgggtcaaagacctgagcagatatttcacaaaagatggtatccaaatgaccaattaacatatgaaaagacacaaaacataattattcatcaagaaatgaacattaaatccacaatgtgcccactctacatccacaataatgactgaaattaaacaatagactccaagtgttgccaaggttgttgaacatttggaatcttatacgttgctggtgggagtattaattggaacaactttttaaaaaaaattgacagtatctactacagctgaaagtatgaatacctacaacctagcaagttcactcctaaatgcataaccaacaaaaacaaatgtgcatgttcacccaaaaacgtggatattaatgatccaaaaagcatcatttataatagccccaaactagaaacaacccaaatgttcatcagtagtagaatgaataaaactttacacactactgacatgtacaataatatgaatcaatctcaaaaacattacactgagtgaaaaagtaagacaaaagagtacataccgtgttattctatttatataaatttatagaaaaggcaaatctaatctatgataagaaaaagtctgaataggggttacctcttgggaagagattaatggaatatagaatcagaaagggccagagggaactttctagggtgccagatgtgttctatatcttgatctatataggggttacacaggcttatatccatatatccaattttatttagctttacacttaagattactgttctttatgcacttttatgtacttatatcttaattaaaaaattttaagctcctgaggtaattcttatattacatttctcctaactcctttgttttgagcctgctttaaaccatgaaattcaacaccatcctcagattcctagaggaacttcctctccttggggcccatattgtccctgtgtctttcctgttctattgctgatcctttttccactttctttttcgcttaggccaatcttataggaatattccagtcactatgttccaagccataactatcggctcttaggatattctatttctgccctcttccctgttccatgatttagaattgttcatgttataaaggttcaagggctcaggggtacttactgaagattgttctttaacattcctcaataagttccactgaaatgtgaatgcaaatatgtagattatcattctaaatgaattaggcactctatgcttatatgctcatctttaaacttacggtaactacacccagttcaccagagaggatataaaatgctacaataataatgaaattcatatctaagaagtttcttcagccaaactgatactatcatgtaaataaagtcctaaaccattcaaggttaccaatcaaaattataatactataccacattcatattttccaaatgtataattacttccaccttaaaagtgttaccattcagaagttatagagttctcaacattttctgttttatattacttaagtgtattttaattatatttattttttgtatagccaccttactaattctcttattagttttaccattaattttgccaaataaatcattccttcttatccttcccctaacttgtagtgtttatttctagaacacagagaaaaaacattgagtttcccaaatcattctgtgagtatagtataattttgataacaaagtcagctagtataaaacaaaacaaaacagagcaataaaaaccctgtagattaatctcactaacagatttttcaaaattaataaaacattagacaattgaatcaagtgatgtattataaaataagctataatgagcaagtagggcatgttcaaaattagggaatgtaatttattgtattaaccaatttaaggtgaaaaattataggatcatctcaataaacagcaaaaagcacttggtgaaactaaatatctgttcatgataaacatttctagtaccttagaattggaaggaaactgtctattttcattctttaaggaagtaatcttgtggctggtctgaggttgtccactctgtctctggcattttaaatggcactgatacttctatgaaccatgtggtgataggcatgactatggccatctctcatagtgaaataggcattcctttgaagttttagggctgaataagaataagaacaacaccaaaacgaataataagaatagctaatttattgagaacttaagtactaggcatcatgttaaaacacgtgatatcgtttatctcatttatttctaacagctacctaatgaatagtttttcttactatccccatttgatggctacgggagcaaaagtaataaagtaacttgctcaaagtcatacagctagtaaataatatatccaagatttgaacccaggtctatctctggttctagaacttgtgctcatagcctttattccagtgtggcctctattatttatgaaaagtgcactataaaaagtgagatcacataaatgctctggaatgtggctctttctttctctctaagcctatcagtatcagtacttcttagtatccactcaagttgtttggccttgtccaattctttccctctggggaagcttcttgcagtgtcttgcagcgacaagtcaattgagttctcacatataccgagttagtgaagaagagaaattagggcagtggagaaatcacttaactaacagtcaggagaatgagtccttgttttggctctgctactaactagctatgtatttgtaaacagtactgtaacatcttagcttcgaaattgtctcctctgtaaaatgaagacattagagtagaatgtttcttttatttgtatttttctttattgttttaaaaattattttataataacttttgtctgacctctgctttattgttttaaaattatcctataataactatttcatctgacttcataacaatctgtggggtaggcaaagcagaaattgtttttctattttacaaattaggccagaatggcaaaggggacttgtccaagttcacataaggcagaacgagggctacaagccttttattgcaatgttcttcccatactacgatagtggcctttaaaaaccctctaggagccaaatacactgatcatcctaaacgttattccttgaggaaatctgtaccaattactacagtccataatctttccacatccacagctgtgagctcatggcaactttttcttccatgtaaatacatttgccatacaatgtgacatttatctccaacttcctcctgctggaccactgtaatcccaccttgtgaggctttagaaggtgctgagacaatctactgaggtgtgatactttattttagagatgatgagtaagttgggggctggggatgtagaactatgtgaggtgagagaatgactggttgtgaaaagtaaaatagttacttattctgaactggttttcatctaagacacttatgatttaaacagtaaccttttagcctgataacatttttttaatctctctctctctctctgagtcattctgatctcagaggcaaggaaccagttttcttctgcaggaaggttattgcttctcccaatgtccaggggatgggggtatcttgagagttggtatttgggtttggtgaggaagcaggaatgacctgccaagggctatggcaaaatctttctctgtctttttatgggtctcattccaagtcctaataattatccaactatttcattcaaacatttgttttgagcagatagccatagtgtctccattttgtatgtatgtatatatgtatgtatttttatatgtatgtatgtatctatcaaatgatccatgctgtgctctgttaggcatcagaatgcaaatataaaaccttaagacagtttcttttgttgccattgcttttggtgttttagtcatgaagtccttgcccatgcctatgtcctgaatggtaatgcctaggttttcttctagggtttttatggttttaggtctaatatttaagtctttaatccatcttgaattaatttttgtataaggtataagcaagggatccagtttcagctttctacatatggctagcaagttttcccagcaccatttattaaatagggaatcctttccccattgcttgtttttctcaggtttgtcaaagatcagatggttgtagatatgtggcattatttctgagggctgtgttctgttccattgatctatatctctgttttggtaccagtaccatgctgttttggttactgtagccttgtagtatagtttgaagtcaggtagcatgatgcctccagctttgttctgttggcttaggattgacttggcaatgcgggttcttttgtggttccatatgaactttaaagtatttttttccaattctgtgaagaaagtcattggtagcttgatggggacaaatgggatctaattaaactaaagagcttctgcacagcaaaagaaactaccatcagagtgaacagacaacctacaaaatgcgagaaaattttcgcaacctactcatctgacaaagggctaatatccagaatctacaatgaactcaaacaaatttacaagaaaaaaacaaacaaccccatcaaaaagtgggcaaaggatatgaacagacatttctcaaaagaagacatttatgcagccaaaagacacatgaaaaaatgctcatcatccctggccatcagagaaatgcaaatcaaaaccacaatgagataccatctcacgccaggtagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcgtagtaaactatcgcaaggacaaaaaaccaaacaccgcatgttctcactcataggtgggaattgaacaatgagaacacatggacacaggaaggggaacatcacactctggggactgttgtggggtggggtgagggggagggatagcattaggagatatacctaatgctaaatgacaagttaatgggtgcagcacaccagcatggcacatgtatacatatgtaactaacctgaacattgtgcacatgtaccctaaaacttaaagtaaaataataaaaaaaattaaaaaaagaacatataacatgttaaaaaaaaaaaccttaagacagtttctgcctttaaagtcttcatgtcatgagaacaacacatgacaatgagcatgatttgcttttaagctatcatttgtatagaacactgttttcttctttgttcactaaatatgaagtagatttgaaaagtgctaatattgcttctgtgaaatgcatctgttggtttttgtaaattttgcctgatgttctcaaaaggggacattgcaatgggagagatttctggctgaagtttgtcagaaatgctgccaaagtgtggaatcagccaaggtttctttggtgcccttccagccaccctgactactggttctcaaatattcaatgccttcagactgttccaagctttacaagcccccctcttatagcatctcatccatttctgccttgcttgggcacctccttggaatttttctatttagtcttttgctagtcaaaatttatctatgctctttttcaaaaggccctggaattggaaaggctaattctctgcatataggcactgattcaggatacacttaagagagggcagccctctttgcctatagtcgattccaccatcaatgcacaaaggataggattcctcctccaggttccaaacctttagaactgcagcctctctatttgtcttctttaccatttttctctaagtcaaattccacagtggctatctttattttgctttaattctagattctataggtgttttactctctattatgggttctgtaatttagaaagaaccacggactaattcctagtgacaactctgacattaacttggaaaattcactcatcataactgaaaggaacccagagttaattttgtacggtggttcccaatctttttacattatgacacagataaaaaacggcatttgtatatttcactgggacgtatagctaagactgcttgcagccaaacgcaactagcctggaggttccagctacccaaagccctgcctgatcgccatgagtgctgaaatgattaatatcttattgtatacctgtagtctgcttgtgggaaccagtgtgacaaagacaataaccaatttggccctaagattttccttttattttctcaccatcctctcttattgaagatgaatttcctgtacaatgtctttccaagtagatttccattctctacttaatacttccagtgttgggaaacctactgcctctctcaaggaaggaagtctattccattgttggctaaatctaatggttatacagttctatttattatcaaactaaaatttgcctctcagaacagaccacattctttcaggtgagattttgtcagagcaaatttaaatatgaattttataccttccttcctttgcatattatactttaattaatgaggactgagattttaccaactttttcagtaactacacactgttgactcaagcttgctgtcaactaagtcctcaaagtctttttttttcatatatgaagcccttaagccaagcctgctttatcttgtgtatttgaaagatttttccattgatcattatacatttttaacaaatattgggtccacttcagctctctccatctatgtccaactcatcaacaaaaatattgaacaaggcaaggactacagatctttctatgtttgataccttttatcccttcacttaactatttcttaaccattttctatttgattatcttaatacctgtagttcctgcccttatggagcttataattaatccagtaagcagaaatgtttgggtataattgttcaattaattgtgaacctatataattctgttgctgtctacttttttatgatgaaaaatataatatgtttcaatataatgtttgacaacgtttcaatacaaaacattgtcaaatgcctgccttattcaatccagatagatgcactatgtatacagcattcatcttatctactaacctactaaccctgtgaaggaactgcaatacatctttaaataagcgtgaaaaaataagttgcaagcttaactgtagcttgccaataagtacacaaatataatttgtgggaatgtgtctgtggattatttgaggggaaaggctccaagggaagccagaattgtgtctctgcatggaaagagaggaggaatgtttggggggtcatataatgagaggaagtgtgatacatgaaagtaattgagagtggccagcacatagcttaaaggcatgccagaaacgtcaaaattaagtaaagcagtccgttgagccccacaaaggtaggaggaacatgattttcagtgtcaggagacatgatgcaaagatggtggttccccagctggaatattttccacaattctggtcattataaatgaggcaaaggacatccaaatgactataaattagccagtgtgggaaaggtatagctggccagctgcctatgccagctattgacaatgttgttatatattgttttttgttaattgaacttagtgtaacattgtgccaagagtgcataaaatgcaaaatattatgcttaggagaaaagaaagctgcttgtcttagtataacagatatttctagatgtaccacataccaagatttgttatttacagtaacttaatttggatcctttgtcgtatcaaaaataagcatggagttttcagtaggtaattagattatttcatcaaaactagctgttggtcatacatgttcattcctggtaatcaccacttctttttctgctcatcattagttcttttttggtaatcagttctaaagccttgactgagttttacatcgaagtcatattttttaagctctgaaaatttctcttatttttttttgaaatgaagaaatacattttctaggctctattttagagtgcctctctcattctccatgagtcttcaaagatcaccaagaaggatctaattcataatttttctcaatatgaatatgattcatctggtcataagacttgaacttactgagtaaactatatactttcttctatttttttcatctatcttgggttataatctcccttttaaatgttctaatatatccagtgtgaataacattctttgacaaagaagatggtggcaacatggtagctgagtaattatgatctaaggataaatattggtgttatcttttgtaatggaaatcagaagacctagattttaatctcacttccctccctgtgctcatatttgctgttatgatttttggcaagtcccttcccctctctggaccttagtggcaaatgaagtgggtcaagtgatgcctaagctcttctataggctttgtgattctaagcatctattagaatattaaatttctataatcatagatgctcactatgttaggctgttttgtgctgctataacaaaattgctgagactaggtaatttattaaaaaacagaaatgtatttcctcacaattctggaggttgggaagttcaagatcacaacactggcattttgtgagggccttctttttgtgtcctcacatggcggaaggtggtggggaagagggaaccagctccctctgtgaagcccctttatagggacacctaattccatttttgagggaggagccctcatggcctaatcacttctcaaaggcctcgtaatactatcacattggcagcacctgaatttttgaggggatacattcaaaccatagaattcatgcttttatgttatccattttccctacagacatcttgggcctcttttgtgttattcctgtgtttttctttcatcctttccatttccagatgtattctttcagtcagttcggatcggctattgaagatattaattaaatcatataattgtatatttgcatttctcacagaatgttcacagtgagaaacaccaacaaatcaaaaagagtcatttgcaaatgaaccataaataaagttatcagtaacatcaatttaaagatatatacttatcagtaaaaagatactgatgcaaactttggaatagtctcattacttggagacatagacttatagaatgttagatgttgcatgtgaaaactgatgttctgggagatgggaatcaatttttccactctcctctgggttccaccaggaaacattttccttacactctcctggcatctgtctgttttctcacctactaattctgatgacttaacccagttggtgaatttaggagcatgaaatgagcaagtgtaattcactctccttcctctccattttctttggagccagttgctcattggaagtgtgcattcttgtctgctcctttatgctttaagttttacagggagagactttcccatgaggatacctatggttatatagcattacctgtggtgcaatattagggaagccacattctccaatatcagctttatcagtaacaaagctaatgttttgacctccatgtgtatcacttttctatctttcaattggtcccaaactcaggcaaagacagagtgaattatattgtgccatccttaaaactcttataaccagaaagtagaagtcctacaaacctagaaggaacatgcaatgtctgtggacttcagtcatgctccattgtgtatctggggagtcattccaataaatgtttatcagagcagaaagattatctattttcctggccaacactttgatgaaatagtctttcactacccccattgacagactgaaatgcctactgtgtgacaatttggtactagacaccctagtaaccttggaaaacttccacaaggaaggcaacacaccagatgtggtcttatggaaaaacctaatacctgtgtttagctttactggccccttccacacaagcttgtgcaggtttgaaaaagacatagctatttctgggggtatctcagtactgtcttattgaatgagatggcctggactgaaatgtagggaaccctacagaccctaatggagtagtatttctagactgaatgggcttgttgtcaaaagggatttctcctcatgtaatagaaattcttctctccttaccttaattatctgtgctctgaatttgtgagaaaacgttctacctccaaaaatagttaggaagaagttcctataatattatcaagatggaaaaaagtctttaacgattgcagtagaatgactccagtacccttcagaagggacagtaaaaaccatgctgagtaagacactggcctatctacttgtgattctgttatgttaatatataaagtatctaattcgaatgtcctttcttttctggctggagaaaccccttagcaaatacttagcgagttaacagtctgtgtttcttcgccagagctcccaaatcagccctttcccttggagtaaaaaagagacccaaaagaagaggggaggaataaccatattgttaaagaactgaaaagagtggctttgtatggcatttttaaatacttggttgaagtgagggaaagaaacagaaaactgtgatgccttgcaaactgtgcaagttaagtcaatctggactagattttatataaatgtgaatgacaaacctgtaatctatcatctcacttatgactgtgcattttattttctcagcaacgtttgattttgaaaacttgtatgttttttcaatgaaaattagagtataatgagttcttttacactctgatcagtcttgagaggacagattcattcaacaaatatttttgagctcctactctgtaccaggcaccttcatgtcttaagaataacaccgcatgttctcactcatagatgggaattgaacaatgagatcacttggacacagagcggggaacatcacacaccagggcctgtaggggcgtggggggctgggggaaggatagcattaggagaaatagctaatgtaaatgatgagttgatgggtgcagcaaaccaccatggcatgtgtatgcctatgtatcaaacctgcgtgttctgcacatgtaccttagaacttaaagtataataaataagtaaataaataaaaattaaaaataaaaaccatgaatacaaattttaaaaaaagaataagactgtcaatctattcatgatgctataacaaaatatctgaggctaggtaacttataagtaacagaaatgtattgctcacaggttgttgggaagtccaagatcaagacaccagtagatttggtgtgtgatgaagcctgctctctgcttcaaagatggtgcctcttgctgccttctcatatggcagaaggaaggccaaaaagggtgggggtgggagtagctagttccttccagcccttttgtaatgtcaataatcccattcatgagggctctgccctcatgacttaatcacctcctaaaggtctcacctcttaatactatcacattggggtttaagttccagcatatgaattttggagggacacatgcattcaaaccatagcaatgagtaaacaatagatatggtttttgtcctcatggaactttcaaatatagtgaggggagatagtcattaaataattacatactagcagtctgtattagcctttataaatgaaaaatacagagagctatgagaacatataaacctgatcttatctgagttgaatgatcggcaaaggttttcctatgaatgagatgtttacactgaaagcaaaagtatgagtaaaagtggggtaagcagacggtaggcgaagagagggagcaggaagacattcaaggcaatggaaacagtatatgaagaggaccaaagtcatgagtgtctgctattgtagaataattaagagctagaaagtgcggctagaaagtagaaaccaagagagtgtatcaaaaagtgaaaccacaatgggagatatgggacagttcttgcagggttcaagattttaaacatgggactttatattaatagcaatgaggagccactgaaagataagattttaagcaatgctggtgtgtgtgtgtgtgtgtgtgtgtgtgtgtgtgtgtgtgtgtgtgtttgagggagagagagagagagagagagaagagaagagaagaagtcaaattggtattttatagagatactactactactctggccctagtatggagactagtatataggaggccaagaaaggtaacaggggaaccagtcttaaggttactaaaatcaccatgagagaatggtgacgacttaaggtagaaatgggaaattatgggcatggggaataagtcatctaatttgagagacttttaggaggtaaaatacacatggcttagttctagattgaatgtgggatattcccccacagtcattttgacttggctgatgggatggatggcaggattgtttgctgagatacaaaatactagaatagtggaatttacttatttattttttggcaggaaagagatgatcagttcaatttgaacactgagtttcggataaatgtgaaatattcaaatagagatacaggcatacttaattttattgtgctttgctctattgtgcttcatagatactgcattttttacaaattgaaggtttgtggaaatcctatgtcaagcaagtctattggcaccattttttccaacagcatgtgctcacttcatgtctgtatgtcacattttgggaatttggtaattgtcacaatatttcaacctttccattattattatatctgttatggtgattgtgatcggtgatctttgatgttactattgtaattatttggggatgccactaactgtgcctctgtaagatagcaaagttgattgataaatgttgtatgtgttctgactgttccactgaacagccattcccttgtctttctctctgtccttgggcctctctattctgagacacaacaatatttaaattaataatcatacagtggcctctaagtgttcaagtgtgatctggtttggctgtgtccccacccaaatttcatcttcaattgtactcccataatttctacatgttgtgggagggacctgaggggagataattgagtcatgggggcggtttcccccatactgttctcatgggagtaaataagtctcacgagatctgatggttttatcaggggtttctgcttttgcatcttcctcattctctctttgccctgctgccatccacataagacaggacttgctccttcttgccttccaccataattgtgaggcttccccaaccacgtggaactgtaagtccaattaaacctctttcttttgtaaattgcccagtctcaggtatgcctttatcagcagcatgaaaatggactaatacaagtgatagaaagagtcgcacatctttcactttaaatcaaaagcttgaagtgattaagcttagggaggaaggcatttcaaaagctgagttagggagaaagctagacctcttgcactaaaccactggccaagttgtaaatgcaaagaaaagctcttgaaaaaattaaaagtgccactttcctgaatacatgaatgattagaaagtgaggtaaccttatattactcatctggagaaagtttgtgtgctctggatagaagatcaaaccaaccacagaattcccttaagctgaagcctaatccagagcaagagcttaactctgttcaattcaatgaaggccgagagaggcaagaaagctgcagaagaaaagtctgaacctagcagaggttggttcatgagttacaaggaaagaagccatctccataacaaaaatgcaaggtgatgcagcaagtgctgatggggaagctgcagtgagttatccagaagatctagctcagaaaactgataaaagtggttacactaagcaatagattttcaatgttgatgaaacagtcttctattggaagaatatgccatctagaactttcatagctagagagaagtcaacacctgatttcaaagcttctaaggacaggctgactctctttttaggggctaatgcagctggtgattttaagttgaagccaatggtcatttatcattctgaaaatccttgggccctgaagaattatgctacgtctactctacttttgctctgtgaatggaacaacaaagcctggaaggcagcacacctgtttacagcatagtttactgaatatttaaagcccattgtggatacctactgctaagaaaaagaagtttctttcaaaatattactgcccattgataatgcacctgctaggtcaagagctctgatggaaatgtacaagaatattaatgttgttttcatgcctgctagcacaacaaccattctgtggctcatggatcaaggagtaattttgactttcaagttttttgtgtggatcctcctatggtacaaagactttcaagccttgttatttttttaaaaacattttttgaggcagagtctcactctgtcatccaggctggtatgcaatggcataatcatggctcactgcagcctcagcctgctgggctcaagtgatcctcctgcctcagcctcctgagtatctgggactacagatgtgtgccatcgcacctggctaatttttaaaattttttgtaaagatagggccttactatgtcactcagactaaaaaatacattttttaatgctaccgctgctatacatagtgattccactgaagtatctgggagaagtacattgaaaaccttttggaaatattcaacattctagatggcataaagaatattcacgattcatgagttgaagtcaaaatattaacattagcaggagtttggaagaagttgattccaatcctcatgatgactttgaggggttcaagacttcagtggaggaagtaactgcagatgtggtaaaaacagaaagattagaagtggagcctgaagatgtgactaagctgctgcaatatcatgataaaactttaacatgacgaggagttgcttctaatgaatgaaaatagaaagtggtttcttgagatggaatctactcctggtaaggatgctatgaacattgttgaaatgacaacaaaggatttagaatattccagttgataaagcagtggtctggtttgaaaggattgactccaattttgaaagaagttctgctgtgggtaaaatgctatcaaacagcattgcatgctacagagaaatatttgtgaaaggaagagtcggtcgagtgggcaaatgtcattgttgtcttattttaaggaatttccacagccactccaaccttcagcaaccaccaccctgatcagtcagcagacaccaacattgaggcaagaccttctaccagcaaaaagattaggacttactgtaggctgggatgattgttagcattttttagcaataaagtatcttttattaaggtatgtacattactttttagacgtaattttacaatgaatatactgcagtttggtgtaaacataacctttacatgtactgggaaaccaagaaattcatgtggctatttttattgtgatatttgctttactgtggtggtatgaacatgaacccacaatatctctgagatatgcttgtattaaagtggcagttggatatatagatctggctaaggaaagatgactaggccagagatgtaaatttaggagccattggcatatagacagtaataataattttgatcatacaaatggatgagatgattcaggaagaatatacagaaggagatgagaggacagcctgggacagaagcctgggaaagtctagcttttaagggaagagtagaggaaaatgatctaactaaggagaatgaagagtgtctggagagttcgagtcaggagtgtgctgtcctggaagccagcaaagaactgttttcatcaggaggacatgggcagcccactgagaggtcaaggaagatgggggccgacaggtggccaggggtggtgacaccatgaaggtcattggtggccttgacaacaagctgatttggtggggtcatggaagccaggccagactggagtagactgagagagagtgagaagtgagatgatggagtgtttgagggggttgacagggaagaggaaggttaagggagagaggaggggatgtagttttgaaggagactgttttcctttttgcttcctgaatattggagatgttgaaaatacaggagaaagagtgagctagagagaatgatcactattataagaaatcagagaaggccaaggagcttgggatccagcttgcagcaggtgaagggactggtcttaaaaaggagtaggaacccttctccgtcagaacagaaggaaaggggggacattgctttagggttttccaaatgtatgcttttcacaattcatttagaatcaataaatctatttagaatcagtattttactaattcaattggaatgtagaaaccttaccaccatatagattcctttaccttccacatctttgtgctatagttgccttacatattatatctatatacattgaacatcctatcagacattttcttgtttttgtttgtttgtttttgctttcaatcatcaaacgtgttgtaaggaactcaagaggagaaaagtctattatttttacccagatatttactatttctattgcttttccttcattcttgatgatccagattttcttttggcatcatttcctctctgtcagaaaactttttttttagcaattctctgaaagcaggtttgctggttttgaattctctttttctgaatcctaaaatgtatttatttcaccattattgaggatattttcattggatttaggattctaggttgacaacctttcattttggtacttgaaaaatgttgtttacttacttctgggccccgtgcttttgaatgagaaatccattttccctatagaatacattgtttttctacggctgatttcaagacttgtttctttttcattatctttcagcaatttgattatgatgtatctggtcatggatttctttgggtttatcctgaatgagattggctcatcattgtaaatctatagatttgtctttgtcaaacttgaaaagttttcaaccattatttcttcaaatattttttcaactcagcactttcttatctccttcttggacaccaattttgtgaattatagaatttttgttattgttccacaggtctctgaggttcattttttcaatctttttttctgtgttcagattggataatttctattgctctatcttcaagttcactgactcttttctctataatctctatttttccagtaagtccatgtagtaatatttgtttgtctgtagggatttcttttttttttttttagcttttattttcagttcagggatacaagtacaggtttgctacataggtaaacttgtgtcataagggtttgttgtacatattatttcctcacccaggtattaagcctagtacccatgagttatttttcctgatcctctccctcttccaccctccaccctccaacaggccccagtgtgtgttactcctctccatgtgtctatgagttctcatcatttagttcccacttataagtgagaatatgtggtatttggttttcttttcctatgttagtttgctaaggtaatgacctccagctccatccatgtccctacaaaggacatgatcttgttcttttttatagctgcatagtattcctttttttgttttttgagatggagtcttgctccgtcgccaggatggagtgcagtggcgcgatctcagctgactgcaacctccacctcctgggttcaagcgattctcctgtgttagcctcccgagtagctgggactacaggtgtgtgccaccatgcccagctaatttttgtattctttagtagagacgggggtttggtagaaaccatgttggccaggatggtctttatctcatgacctcatgacccgcctgccttggcctcccaaagtgctgggattataggcgtgcaccactgcacccgaccatattccatttttatttaactgattatttcagttctaaaatttctattgtgttctcctttatattttttatttctttgctgataccttcttttttaatatttgtttcaaaagtgttcacaattgcccactagataattttcataatactttctttaaagtttttgtcagataattattgttggcatctattgtcctttcccatgcaagccgagattttcatgcttctttgtacgccagctggtttttggtttatatcctgaacattttgaatattacattttaaggcattcaatctgatttaaatcctaggaaaatattgatattttttagtcttctttgtaagtttagttttcaaagtttttgcagtgctatttgggtctatgccacccagtggtcagtctgaggcgtaggtgaagatctacttgttagctcagttttcaaagtctttagtataatagttagtatcaaatccatgaataaatgagtcagggtaacatcatgagttcaacagctttatggagtcacttctccaagttcctctctctgttatctcccagtatttttctgttcctaagtaacatattttcagtcttccagcccaaaactgccccttccataattatactatgtccagcagaaggacaaagaaagggttaaaagcaatgggatttggccctgccctcttggagctatatctgcatccaatagagaagaatgttcccttctctcagagttttggctcctgcatactttcattgccaggctatattgctgccacaatattatctggaggctgggaacatgagaatgaagaaaaaggaaagaagaaacgggatattcttccacccctgaattttagatattacctttcctgctccttgagccaggcttctgagatttgagttgaggccaggggctgccagaacaaaaaaacatgatgctggtttgttggtactttgaattgtgatgttttttcataatatatctgctatttactttttagcattctcaaatagctgttcatgcattctgtccacattttgaagttcagttcagtgggagagaaaggaaggtatacattattattccacctgtgcaagaactgaaaggttttccacataagtcctttagaattttcaacttgcacattacccagaacagggagtttgcaacaaaacatcatttataaattgatcaggcaatgtgccaagcccaacttggcttaggctttgagcctgactgacatgcttgctttcctttctcagtatagaccaggataactccatttgacaaaaaacagttgtctatactcacaagactaatatttcaattagaactcatatttacaactggtcaggaacttaatccaaattgactttatcaaaagggaaatgtattggctcatgtaacagaatagcccagggatagatctagttttagataacatgactgaatccaggaactcaaataatgtcaaggcatgagctctatccatttctcagttatgctttcctcagcattatatccatttcttacagattcttccctcattgtagcagggtagttgccagtaactcctggtttacaatttcatgactttaagtccagcagaatagaaaacatctgtttgtctattacttgaacgagattactggcattatctctgatcagatcagaatagtgtacttgagtaacatgctcatatcttaaccacatattgtggcttacaagagtgattggccagacctgtgtggcatgtaaattcttggaattagaaatagagagctttatccaaagcatggaaagtgaatggatacagagggagagcattaggacaaatacctaatgcatgcagggcttaaagcctggtaaatgtgtgccatggtggtttgctgcacagatcatcccatcaccgaggtattaagcatagcatccattagctattcttcctgatgctctccctccccccacccctcccccgccccattgtgtgttgttctcctccctgtgtccatgtattctcatcgttcagctcccacttataagtgagaacatgcagtatctgcttttctgttcctgagttagtttgctgaggataatggcttcccactccattcgtgtccccgaagaggacatgatctcgttcctttttatagctgcatagtattccatggtgtatatggaccacattttctttatccagtccctcattgatgggcatttaggtttattccatgtctttgctattgggaatagtgctgcaatgaacatatgcatgcatatgtctttataatagaatgatttatattcctttgggtatatacccggtaatggaattactgggtcagatagtgtttctgtctttagctccttgaggaattgccacactgtcttccacaattcttgaactgatttacactcccaccaacagtgtaaaagcatttttttcttcaaaacctttccagcatctgttatttttttgactttttaataatagccattgtgacggatctgacatggtatttcattgcggttttgatgtgcatttctctaatgatcagtgatgttgagcttttttccatatgattgtcagacgcatgtatgtctttttttaaattgtttttttttttaagttctggggtacatgggcaggatgtgcaggtttgttacataggtaaacatgtgccatggtggtttgctacatttatcaacccatcacctagctcttttccctaatgctctccccaccactgccctcctccgacaggccccagtgtgtgttgtttccttctctgtgtccatgtgttctcgttgttcagctaccacttataagtgagaacatgcagtgtctgttcatatcctttgcccactttttaatagagttgctcagctttttcttgtaaatttgtttaagtttcttatagatgctggatattaaacctttgtcagatgcataatttgcataaattttctcccattttgtaggttgtctgtttgttgatagtttcttttgctgtgcagaagctctttagaataattagatcccgtatgacaatttttgcttttgttgcatttgcttttggtgttttcatcatgaaatctttgcccatgcctatgttctgaatggtactgcctaggttttcttccagggttttcatagtttgggattttacatttaagtatttaatccatcctgagttaatttttgtatatggtgtaaggaaggggtccagtttcgatcttctgcatatagctagccagttatcccagcaccatttattgttgttgttgttatgcctcttagggaggggttcctcctcctcattttttgggaatagtttcaatataaatggtcccagattttctttgtacatgtgatagaatttggctatgaatccaactggtcctgggcttttactggttggtaggctatttattactgattcaatttcagagcctgttattggtcttaggagtgtgtatgtgtccaggaatttatcaatttcttccagattttctagtttatgtgtatagaggtgttcataatatcccagcgattctttgtatttctgtggggtcagtggtaatatcccctttgtcatttttaattgtgtttatttagatcttctctcctttttttctttcttagtctagctgacagtctatctattttattgatttaaaaaaaaaacaactcctggattcatttatcttttgaatggtttctcatgtctcaatcttcttcagttcagctctgattttggttatttcttattttctgctagccttggggttggtttgctcttggttctctagttcatttcgttgtgatgttagtttgttaaattgagatctttataactttttgatgtgggcatttagtgctataaattttccttttaacactgccttagctgtgttccagagattctggtatgttgtgtctttgttctcatcagtttcaaagagcttcttgatttctgccttaatttcattatttacccaaaagttgttcagaaacaggttatttaatttccatgtaactgtatggttttgagcaaatttcttagtcttgatttctaatttgattgtgctgtggtccaagagagtggttgttatgatttcacttcttttgcatttgcttaggagtgttttgtgtccaattatgtggtcaattttagagcattgccatgtggcgatgaaaagaatgtacattctattgcttttgggtagagagttgatgtctgtcacgttaattacacatatcagtaacaaccatgaatataaacaggctaaatgccccaattaaaaggcatagagtggcaatctggatagagaaccaagacccattggtatgctgtctttgagagactcgtctcacatgcagtgacacccataggttcaaaatatagggatggagaaaaatctaccaagcaaatggaaaacagcaaaaagcaggggtttcaatcctaatttcagacaaaacagatttaaaccaacaaagttttgaaaagacaaagaagggcattccataatggtaaagggttcaattcgacaagaagacctaactctcctaaatatatattcacccaatacaggagcacccagattcataaagcaggttcttagagaccttcaaaaagacttagactcccacacaataatagtgggagacttcaataccccgctgatagtattagacagatcatcaaagcagaaaattaacaaagacatttacctgaactcagcactgaatcaattggacctgaaaaagttctttttctattctggatgaacttatatcaattctggatatacctttatcaatatatgtgtgatgaatttttttcattctagcttgctttttcattttcttaccaacttttttcaaagagcaaaagattttaattttgattaagttaaatttttgtaacatttttattttatcgtatatgatttgtgtcctatctaaggagtattgccttcctacaaatttgaaaatatttttcctatgttttctcctagaattgttacggttttatctatttaatttttcgtgtttaaccctgtgcttgtttgccccaagaatactcatcagtggcacttgcagctgcagcatttaccctgagataactttgccgcaaaatatttcacttttattattatttttgcattgctcaattatatcaactttggaaacaaaaggcattattctatttatagcattctgtttttagtggtggtatttacatttacaaaatccagtaattcttgattgctgaaaatttcaaattctggaatacacagcattcctacacgtgatgttaacattattttcaaacaattgttggccaaagattcatttgatgaattcgatttttctgaaatagatgattctgatgattcagaaggttctgatgttagttctgtttagaaataattccaagaacagtttttatattttattttcacattgaaaatcagtcatatttgctccagcctcaaagagggtgtttgtgtaaaattaaaagagtgctggcagtgagctgcacttttttttctaaatggaaaaaggattaactattatggatattagttgtacacatttatagggtacatgtggtatttttatacaagcatacaactgcaataatcaaatcacagtaactgggatatccatcgcctcaaccatttattatttcttcatcttaggaacattccagtttcactcttttagttatttagtaatattcaataaattattgttaactatagttgccctattgtgatactgtactctagatttttttatttccatctaactatatgttttttaagatggggtcttactgtgttgcccaggctagcctcaaactcctgggctcaagcaatcttcccacatcaacttcccaaatagtaagtgtatttttgtaccctttttgttaagtgaaataagccaggctcagaaagataactattacatattcttactcatattgggagcttaaaaaatgaactcgtggagatagagagtagaatgatggttaccagagactggtaaggttagtggggaggagggataaagagggaatagtaaatgggtacagctttatattttacatttagctccctggttgattttgagttaaattttgtgtacactgtgaggcaaaagtcaatgttcatttttttttccatgtgaatatccagttgttctagcactatttgatgaaaacacattttactccattgaattgccgttgaatctttgtagaaaatgaactgaacatgtctgagtctattatgtttcagtgacctatatgtctatgctttcaccaatgtctagctctcttgattactgtaactataataaggctaacttaagccctgtaatttctctaatattgtttatattttaaaaaattgatttgcattttctaggttatttgtgtttccatataaattatactatcaacttgtcaatgtttatagaaaaaaatctgctgaggtttttattgttatcgcattaaatctatatgtcacttcgctggtatttttttcccttaaatgtctgatatacttcagtgaagccatctggacctgggatttcttagatgtttagtaacaaattaaatttactacatataatgttattcatattttctgttttagcttctgtccatttttgtaggttatatttttcaaggaatttgttcatctaaattgtcaaatattctaacataaaatcgttcacaatacatacttattaacttttaatgacttaatgatatgtactgatgtgctctttgctatttctgatattgtttgttttctctctcttttattttcttgatctatctggatgtttgttgattttgatctttagttgatctttaatttatttattacgtttttcttctatttcattgttttttcctctttattttttctttcttctactcacttacctcagttatactttgctctttttctagcttcttaatcattgatttaaggcctttttcctttccaaaaaacatttacaactttgattttcgttctaactactgtatcatcttaatccaacaaatatttgttacatattcattatcattcatctcaaaatattatctaatgcctcttataatttattatttgactcatgatttatttagaagtgtatttttaaatctggaaatatttggagtttctgatgtatattattgatatttatttctaatttaattccactgtggtcagagaacatcctctgcatagtttcaatcactttatatttattgaaacttgttttatgacccagaatatagcccaccttagtaaatgcaccatgtgtacttgacaataatgatgtgtattctgcaattgcctggtgtggtattttataaatattaagtcacagtagttgctaaagttgttcatgtcatgtatatctttactgacctttttgtttagttgttgtgtcaattgctaaagcataggtgttaaaatctcctacaacaattttagggttgtttatttctctctgtcaatttttgtctcatgcactttgaggctctattataggcatgtacacatatatcattcttatgtcctcctgataaacagtctctttgtatctttaagtttaaagtgtgccattttgaggcaggatataattatatttttatacatactgataatctctgtattttcattggaatgtttaattcttttttctttttcttagagacagggtcttgctatgttgctcaggcaggaatacaatggcacaatcatagctccctgaagcctccaactcgtgggctcaagtgatcctctggcctcagccttctgagtagctaggaatgactacaggtgcacaccaccacacctggctaatttttattttttgtagagacaaggtcttgctatgttgcccaggctggtctaaaactcctgacctcaagtgatcctcctgccttggcctcccaaagcactgggattataggcatgagccaccatgcttggccatagaccattaattcttaatgcaatttttatgtcattggacctagctctaccattttattgttttatctttgttccctctgttttattgttcctccatttcccatttactgtcttctttcagactattgtaatctttttattattcagttttctctgtggccttttaagataatatatttgtgtgtctgtgtgtgtacgtgtttgtgattttagtggcttctctaaggattgaaatatgcgtcatctttacagtccatttacagttaatattgtaccacttcttagaaaacttagacaccttggaaacatacagacctctctacacaccctgattattctttatatcagtggtcccagtccttttggcaccaggcaccagtttcatggaagacaatttttccatggaccggggtgggtgagggacaatggtcttgggatgattcaagtgcattacatttattgtgcactttatttctattattattacattgtaatatataatgaaataattatacaactgaccataatgtagaatcagtgggagccttgagcatgttttcctgtgactagataatcccatctggggttgttggaagacagtgacagaccgccaggcattagattctaaaaaggagtgcacaacctagatccctcacatgcgcagttcacaaaagagttcacgcttctatgagaatctaatgtggtggctgctgttctgacaggaggtagcactcaggtggtaatgcaagcgatggggagtggctgtaaatacagatgaagcttcactcacttgcctgccggtcacctcttgctgtgtggcctggttcctaacaggccacagactggtactgctttgtggcccagggattggggacccttgctttatgttatagttctcatacatattaaaactatatgtattaacaatttcacaagataatgctataatttttgctttaaaagggcatatgcattttaaagaaattatgagggaaaaaataatctttcatatttagtgtctctgatgtccttcttttagcatttcttctaatgcaggtttgctctgcatgaattttcttagttttccttatctagaaatgttgttatttcatctccattattgaataatattttcacaatttataaaactagattgatcattttttctttccacatattaaagaatcatttcattgtctctatgggttatctctctatgggttatgatgagaagtctgcagtcactcaaattattgttttcttctatgtaatgtgtcactgttctctagatgcttttaagattttcttttttttggttttcggtagtttggttataatgtgcctaggaattttttttaatgtattctgattgaaatctctagatatgtacatttatggcttacatcaaatttggaaaattttcagccataatttctttacatatttttctgccccattttctccctctgtttcttgactccaattatacatatactgaacattttgatattgtcctacaaatatctgataatctgttcattttaaaatattttttccttctcattttcaggtattataatttctatgaatctatatttacattcattttctttttcctctgtcacctctatttttctcttaagcccatctaatgaagttttaatttcagcttttgcattttttatctccaaaattttcttttttgtgttttctatttttctgctgatatttccaattcacttctagtgtaatttctttcattaatttaatatagttataatagctgctttaaagtcctcatatgacaattttaacatctaggtcatctcagagttggcctgtgctgattatattttctcttgagaattggtcacattttcctggctgtttgtgtgtccagtaattttggattatactctgaatattgtggacattatgttatggaggatctgggttctgttatatttgtccaatgaatgctgatgttttgttgtctcagaaaatttaacggggaacttgccctcttgccagttttgactaccttactctatcttccttcttttgtttatacttcacaattctcaagtgtttattacatacacacacaacacacacacacacacacacacatatatatatacatatatatacagagagagagagagagagagagtctggagttaatagtggttgctatttgtggcataattggtccgtacagcacttatcatgtcatctctgaggcagcacctccttcttgattgtttaaaggtaaatttgatattttgaagtgtccttttatacccccaagactttgataactgagtttagttaaaacaaatatacacagcaacttgctaaattttaaaaatcattttcccagaagtcaaaatcatttttctcctttcatttgcataatcttttctcttcttgcaattaatagcactcaacaaaattaagcctaatgtagttgggcagacaataatttcaagacctctgtgtctaggcccctttgtattgacattgagaataacttggtcataaaataaggtttaatatgacaaataaacacagccaccactagccaccactaacaaaaccagaaccttcattccagggttttaccccataattcagtatggacaatccaactgagtttctggtttagataaatgatttcactttcctcaaagacatgagtattggaaacttctgggttggtgattttgacatgtattctcaaaacaactagaacttttatagttattcctttttaaatgtcaagattaaatctgtgatcaaggaccttttaagtatatcttaagaatcaggatagtacaatctagtaatgggtacttacaatgtaccaccaggcactattctaagtgctttatgcatatcatctcatttaatcctcacagtagtcctgtgaagtaagaactattattgtacccctgtgatggttaattttatgtgtcaacttgactgggccatggaatgcacagacgtctagctaaacattatttttggttgtgtctgtgagggtgtttcgacatgaggttagcattagaattgttagactgaataaaaatattgcccttcccagtgtaggtgggcatcatccaatccattcaggacctgaatagaacaaaaggtagaggaaaggtggattctttctcttcctgactgcttaagctcagacattggtcttcctctgcctttgaatttggacgggaagttacagcctcctttctcctggttctcagtccttcagattcagactagaactacaccattggcatttctggatatccagcttgcaaatggaagactgtgagacttctcagcctccacaaacacacgagccaattagccaatttttttattatacacatacacacacacacacacacacacatatatatatatatacacatatatatctgattgtgggacaatgtgaggattaaatgagattatatgcataaagcacttagaatagtgcctggttgtgcattgtaggtaggggtgtgtgtgtgtgtgtgtgtgtctgtgtgtgtgtataaattggttctgtttttctggagaacgctgactaatgcaacccatttctcatataaagaaacttagacatggatttgagtttgagtcctggtttctctttgggcaggaagagtagatgaggtaagactgaacttaggtaatcctgagtccctagggaaattccattatgatactatttgtatcagttagaaatttttggttataaataacagaaaacctaattcaatctttctcaaaaaatagtgaatatgtggttcatatattagtaaagaatgccttacagaggcttactcaaacaagaatgtattattatcatatatcaagaagtttctaagtaggttgcttcatgggtttgtttagcagcctgacaatgtcacaatttttacaattatctttgcacttccctcatgcttgtcacttcatggctacaaagtagtgctgcagctccagagatcaaatctgcattcaatgcaagaaataaagatggatgagtagtaccactcatatatgtcccctttatcaagaaaaaaacaaaaaattgttggaaattcctcagcaaaatttcacttatatctctttggcaaactgtcatatggccacatctagttacaaaggaggatgataaagtgaatattcagatttttctgcctttagagtggcaaaccacataaaaaatggatttgggaatggatgttgggtcagctaattggcagtgtctaccacattccatttctctgcatctcttagttcttccttctttgctgtataaacttcatcttcaggctaaccctgatatggtggcaagatgttttctgcttatctaaagctcacatcctcatgccatcaattcccagggaagagaaataacttatctttaaccagtatatttttttcattttataggctctcaatgaattgtgtaccaatccccaaatcaattactttgaccaagatggttgagaatgtgagaagagtagtttcaaaaagggaattcaaggtattgttatcagaagtagggagtaatggatgctgagaagcaagcaagtaatcaactatctatccctatttcaccatccactttaatattttgtgactctttccttccccatttgcactagagacaatctggttagactgtgctgattaatacggaatggctatcaacgtgtagttgggtattacatgtgaaaatcaatggtgtagagatttccccagtcaatgaatatcctatatcaaaatttaacctaataagtggtatccacataggactataactaacatcataataatgaaagactgaattcttgtttccactaagattgaaaagaaggcaaagatattcactaacaccactcataatcaacattgtattggaatccctagccagtgctaagatttaagtaagaaaaaagaaatataagacaaacagattggaaagtaagaaaggtgactctctctattcacagacaacaacagtgtctctatagataatcccaaagagtctacagaaaaacttctagaactcatagtttttttgaacccatcagggagcttgggtttcagagcaaacagttggcccgtatctaagggagaaagaatggtgcatgtgacaaaagagaagacaaaattacacactcatataagacacaacaagaaccttgtaagaagcattgagctagaatagttgacaacgtggtgaagcctgagagtaatctggcaagacagcgtgaaacccctatgtgccaagaacttggaggggtcagtgtcaccttgcacggtcctccatgaacctcaacgggtgctcccagaaaatatcagaaagcgttctagaagtgtatgttgtgatgcagatttggagtaagatatcagtagctatgctggaggaacaag

SEQ ID NO: 633 - DNA, 18 bp, Homo sapiens
aaactcatatccagtggc

SEQ ID NO: 634 - DNA, 14966 bp, Homo sapiens
atccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggc

SEQ ID NO: 635 - DNA, 1625 bp, Homo sapiens
gcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggc

SEQ ID NO: 636 - DNA, 11292 bp, Homo sapiens
cataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaa

SEQ ID NO: 637 - DNA, 1430 bp, Homo sapiens
agttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctc

SEQ ID NO: 638 - DNA, 3735 bp, Homo sapiens
agttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttat

SEQ ID NO: 639 - DNA, 1847 bp, Homo sapiens
aaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagc

SEQ ID NO: 640 - DNA, 3311 bp, Homo sapiens
taaaagagaatagtttgggaggtgggtgtttctgtgatttttttttcttttacaaaaagagagtcatggagcttccagtgatgtgatcctggcagaaaggcaggttttaatttccccaaaattcctcctggaaaacaaacaaatcaattaggatagccaataataaatgcactgttaatatcttaaataaaaatcaaaggcaataaattctcataaatttcagattatgaacaggaatggtaaatcacttacagcagtataacaagaacaagaacaagaacgaagttgtgtgacagtaatagtgaaaaatgaatagggacaacctatgtatgccacaaactcggggtgtaaaaaatttttctacaaacatctactaaaagaagaagatcctatattccttgggtggaaacatggtaagacatgtgagaatgcccagtgaaactgggaaaagtcctcagaatcttccatttgcagataagattaaaaaactgcttgcagacataaaaacattatggttctaggctaatttcaatttatagttaaatgaccacagagttaagccactagctaatttccatttagtgttaaaagacataataaagaattagagaaatccagaatgggaggcattctatagaacaactaaactaatttctataagtgaatggctgaaggaaaagggagcagaggaagaactattctaaattacgagtgacctaaaaaacaaacatattaaaatgtggaccttgtttagattttaattcaagtaagccagaaaacacatttttgagaaaatccatacatttgattaagaccaggtatgagattatgccaaagaaacattatgagtgataataatattgtggttttgtagtgggccataatttttagagttatactgaattatgaaggggtaaaataataccatctgatatttgctgaaaaatacttcaaataagaaaaagaaaaaacgtgttttaaataggttaagtgatcccaagttacagtaatctaaacggtgtggtactgacataaggacagacatatggatcaatagaatagaatagaggtcccagataaacccttgtgcacgcactcaatcaatctttgacaagagtgccaaaaccatacaatgggcttaaagggtagtcctgtcaataaatggtgttgagaaaactggatatccacatgcaaaagaatgaagtcggatccttactttacacaatatacaaaaataaactcaaaatgaattaaagacctaggcataagaccttaaaatataaaactataagaagaacacaggagaaaaattttataacagtggatttggcaatgttttcttggagatgacaccaaaaccacaggcaataaaagcaaaaatagacaaatgagagtacatcaaacttaaagccttttgcacatgaaaggaagcaatccttagagtgaaaaattaacctacgagatgggagaaaatatttccaaatcatatatctggtaaggagttagattcagaatatataaagaatgcctataatttaacaacaagcaaatagcctagttaaaaaaatgggtaaaatcctcaaagtggtatttctccgaagagttataaatggctaacaagtgacaagatattcaatgtcactaaccattagagaaatgcaaatcagaactataatgagatatcacccattaagatggtgatatggtttggctctgggtccccacccaaatctcatgtcaaaatgtaatctccacatgtcagaggaggggcctggtgggagatgattgctcatggggacagatttcccccttgctgttagtgtgttctcatgagatctgatggtttaaagttgtgtggcacacttcccccttctctcggtctctatcctgctgcaccatggtaaaatgtgcttgcttcccctttgcattctgccataattgtaaatttcctgaggcctccaaaacatgcttctgtacagcctagggaactgtgagtcaaacctcttttcttcaattacccagtctcaggtagttctttatagcagtgtgagaatggactaatacacatggccactgtcataaaaacagaaaatagcaagtggtattggaatgtggagaaattgcaattcttgtgcactgtcaatgggaattgacaatgcagccagtaagaaaaacagtatagagtttcctcaggaaactaaaaatgcgattaccatatgatccagaaatcccactctgggtacatatccagaagaattgaagacagactcttgatgacgtattttcatatccatgttcattacagcattattctcaataccaagaggtgaaagcaacccaaatgtccactgacatataaatggatacagagaatggagtatatacatacagtggaatattacttagcttaaaaagagaaggaaattctgtcatgtgctataacattgatgaaccctgaagacattatggtaagtaaaataagcccagtcgcaaagagaccaacactgtatgattccacctgtataaggcatctaaattggtccaactcatagaaagcagaattgtggatgtcaggggctgtgaggaaggggaaatagagagttgtttttcgatgggtatagagtttcagttttgcaaaatgaaaaacttttagagatctattgcacaacaatgtgactattgttaacactattgaactatacacttagaaatggtcaagatgctaatttttatgttaaacatgttatgttaaaatgtgttttctaccataattttaaaaataaataaataaattagttctgtgaacgcgacaaaatatcgattattgttttatcttggtgattggtatatctagtactactttaattttgtgtctatatcaaaatttttttaatttttagggaaaaagaaatttgaaagaattatgacagagtattaatatctgttcattcagggaagggagcaaatgggtgttttctgtgtgtttggaatatctcatcattgataaaatccaaaagtaatagcagtagccaactggcaacatagaaccttaagtttacccagtttgaatctatgggtcataattctcaattatctggagagacaatcatattaactagtccagtgagaccagtggagattatataatccaaatagagttgtactggggaagtggggtcagttctgagaggagcgatatgggcttttagagtttccagaaaaatgtttgctacagattaaaaggacaaggattttcacggtagattaaaaagtttggtaatatggcctggatgtttcatagcttgatgcca

SEQ ID NO: 641 - DNA, 6607 bp, Homo sapiens
tctgtctttgagtaagccttcggcaccgaacagtagtccatgacattgggggaagccagatgagactcagattgtcagtactcaggctgtcgccagcaaagcctttccccttttttcagagacagtactacatccaagaggtggaaagatacttttgttttgttttgtttatttatttatttgttattattataagttttagggtacatgtgcacaatgtgcaggttagttacatatgtatacatgtgccatgctggtgcgatgcacccaccaactggacatctaacattaggtatatctcccaatgctatccctcccccctccccccaccccacaacagacctcagagtgtgatgttccccttcctgtgtccatgtgttcccattgttcaattcccacctatgagtgagaatatgtgatgtttgcttttttgttcttgcgatagtttactgagaatgatgatttccaatttcatccatgtccctacaaaggacatgaactcatcattttttatggctgcatagtattacatggtgtatatgtgccacattttcttaatccagtctatcattgttggacatttgggttggttccaggtctttgctattgtgaataatgccgcaataaacatacgtgtgcttgtgtctttacagcagcatgatttatagtcctttgggtatatacccagtaatgggatggctgggtcaaatggtatttctagttctagatccctgaggaatcgccacactgacttccacaatggttgtactggtttacaggccaccaacagtgtaaaagtgttcctgtttctccacagcctctccagcacctgttgtttcctgactttttaatgattgccattctaactgctgtgagatggtatctcattgtggttttgatttgcatttctctgatggccagtgatggtgagcattttttcatgtgtgttttggctgcataaatgtcttcttttgagaagtgtctgttcatgtccttcgcccactttttgatggggttctttgtttttgtcttgtaaatttgcttgagttgattgtagattctggatattagccctttgtcagatgaataggttgtgaaaattttctcccattttgtaggttgcctgttcactctgatggtagtttcttttgctgtgcagaagctctttaattagatcctatttgtcaattttggctttggttgctattgcttttggtgttttagacatgaagtccttgcccatgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctattccattgatctatatctctgttttggtaccagtaccatgctgttttggttactgtagccttgtagtatactttgaagtcaggtagtgtgatacctccagctttgttcttttggcttaggattgacttggcgatgtgggctcttttttggttccatatgaactttaaagtagctttttccaattctatgaagaaagacattggtagcttgatggggatggcattgaatctgtaaattaccttgggcagtatggccattttcacaatgttgattcttcctacgcatgagcatggaatgttcatccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgctggtgtataagaatgcttgtgatttttgtacattgattttgtatcctgagactttgctgaagttgcttatcagcttaaggagatgttgggctgagacaatggggttttctaggtatacagtcatgtcatctgcaaacacggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttattgaattttgtcaaaggcctgtctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttcatatcaggatgatgctggcctcataaaatgagttagggaggattccctctttttctattgattggaatagtttcagaaggaatggtaccagttcctccttgtacctctgttagaattcggctgtgaagccatctgctcctggactctttttggttggtaagctattgattattgccacaatttcagctcctgttattggtctattaagagattcaacttcttcctagtttagtcttgggagagtgtatgtgtcgaggaacttatccatttcttctagattttctagtttatttgcatagagctgtttgtagtattctctgatggtagtttgtatttctgtgggatcggtggtgatatcccttttatcattttttattgcgtctatttgattcttctctctttttatctttattagtcttgctagcggtctatcaattttgttgatccgttcaaaaaaccagctcctggattcattaattttttgaagggtttttaatgtctctatttcctttagttgtgctctgattttggttatttcttgccttctgctagcttttgaatgtgtttgctcttgcttttctagttctcttaattgtgatgttagggtgtcaattttggatctttcctgctttatcttgtgggcatttagggctataaatttccctctacatgctgctttgaatgcatcccagagattctggtattttgtgtctttgttctcgttggtttcaaagaacatctttatttctgccttcagttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatttgtgggagtttaagtctctttgtaggtcactcaggacttgctttatgaatctgggtgctcctgtattgggtgcatatatatttaggatagttagctcttcttgttgaattgatccctttaccattatgtaatggccttctttgtgtcttttgatctttgttggttaaaagtctgttttatcagagactaggattgcaacccctgcttttttttgttttccatttgcttggtagatgttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaaggtaatattgttatgtgtgaatttgatcctgtcattatgttagctcgttattttgctcgttagttgatacagtttcttcctagtctcaatggtctttacattttggcaatggatggtacaggttgttcctttccatgtttagtgcttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgcttgtttctttttattcttttttctctaaacttcccttctcgcttcatttcattcacttcatcttccatcactgataccctttcttccagttgatcgcatcagctcctgaggcttctgcattcttcacgtagttcttgagccttggttttcagctccatcagctcctttaagcacttctcagtattggttattctagttatacattcttctaaacttttttcaaagttttcaacttctttgcctttggtttgaatttcctcccgtagctcggaataatttgatcgtgtgaagccttctctcagctcgtcaaagtcattctccgtccaactttgttccgttgctcgtgaggaactgcgttcctttggaggaggagaggcactctgctttttagagtttccagtttttctgctctgttttttccccatctttgtggttttatctactttttgtctttgttgatggtgatgtacagatgggtttttggtgtggatgtcctttctgtttgttagttttccttctaacagacaggaccgtaagcttcaggtctgttggagtacccggccgtgtgaggtatcagtctgcccctgctggaggctgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggatactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcactgccgccttgcagtttgatctcagactgctgtgctagcaatcagccagactccgtgggcgtaggaccctccgaaccacgtgcgggatataatctcgtggtgcgccattttttaagcccgtcggaaaagcgcaggattcgggtgggagtgacccgattttccatgtgccgtctgtcacccttttctttgactaggagagggaactccctgaccccttgcacttcccgagtgaggcaatgcctcgccctgcttcggctctcacatggtgcgcgcacccacttacctgcgcccagtgtctggcactccctagtgagatgaacccggtacctcgactggaaatgcagaaatcacccatcttctgcgttgctcactctgggagctgtagaccggagctgttcctattcagccatcttggctcctcccctcttgttttgtttttagacagagtttcgctctgtcgcccaggctggagtgcagtggcacgatctcggctcactgcaaccttcacctcctgggttcaggcgattattctgcctcagcctcccgaggagctgggattacaggcccgcaccaccacacccagctaatttttgtatttttagtagagacggggtttcaccatattggctacgctagtttcaaactcctgacctcaagtgatcctgacctcaagcaatctacccgcttcggcctcccagagtgctgggattgcaggcgtgagccaccctgcccggcaggaaagatacttttttagaaagtatgttttaccttaaaaacaacatatatataatcaatttttaaaacttaagtgattataattttttttcttaaatattgtaatatacatgcaaaggcc

SEQ ID NO: 642 - DNA, 6667 bp, Homo sapiens
ctgcaacacaatgtgtagaacttaacggaatgaagttttcttttggaggcttccaatgcgtctgtctttgagtaagccttcggcaccgaacagtagtccatgacattgggggaagccagatgagactcagattgtcagtactcaggctgtcgccagcaaagcctttccccttttttcagagacagtactacatccaagaggtggaaagatacttttgttttgttttgtttatttatttatttgttattattataagttttagggtacatgtgcacaatgtgcaggttagttacatatgtatacatgtgccatgctggtgcgatgcacccaccaactggacatctaacattaggtatatctcccaatgctatccctcccccctccccccaccccacaacagacctcagagtgtgatgttccccttcctgtgtccatgtgttcccattgttcaattcccacctatgagtgagaatatgtgatgtttgcttttttgttcttgcgatagtttactgagaatgatgatttccaatttcatccatgtccctacaaaggacatgaactcatcattttttatggctgcatagtattacatggtgtatatgtgccacattttcttaatccagtctatcattgttggacatttgggttggttccaggtctttgctattgtgaataatgccgcaataaacatacgtgtgcttgtgtctttacagcagcatgatttatagtcctttgggtatatacccagtaatgggatggctgggtcaaatggtatttctagttctagatccctgaggaatcgccacactgacttccacaatggttgtactggtttacaggccaccaacagtgtaaaagtgttcctgtttctccacagcctctccagcacctgttgtttcctgactttttaatgattgccattctaactgctgtgagatggtatctcattgtggttttgatttgcatttctctgatggccagtgatggtgagcattttttcatgtgtgttttggctgcataaatgtcttcttttgagaagtgtctgttcatgtccttcgcccactttttgatggggttctttgtttttgtcttgtaaatttgcttgagttgattgtagattctggatattagccctttgtcagatgaataggttgtgaaaattttctcccattttgtaggttgcctgttcactctgatggtagtttcttttgctgtgcagaagctctttaattagatcctatttgtcaattttggctttggttgctattgcttttggtgttttagacatgaagtccttgcccatgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctattccattgatctatatctctgttttggtaccagtaccatgctgttttggttactgtagccttgtagtatactttgaagtcaggtagtgtgatacctccagctttgttcttttggcttaggattgacttggcgatgtgggctcttttttggttccatatgaactttaaagtagctttttccaattctatgaagaaagacattggtagcttgatggggatggcattgaatctgtaaattaccttgggcagtatggccattttcacaatgttgattcttcctacgcatgagcatggaatgttcatccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgctggtgtataagaatgcttgtgatttttgtacattgattttgtatcctgagactttgctgaagttgcttatcagcttaaggagatgttgggctgagacaatggggttttctaggtatacagtcatgtcatctgcaaacacggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttattgaattttgtcaaaggcctgtctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttcatatcaggatgatgctggcctcataaaatgagttagggaggattccctctttttctattgattggaatagtttcagaaggaatggtaccagttcctccttgtacctctgttagaattcggctgtgaagccatctgctcctggactctttttggttggtaagctattgattattgccacaatttcagctcctgttattggtctattaagagattcaacttcttcctagtttagtcttgggagagtgtatgtgtcgaggaacttatccatttcttctagattttctagtttatttgcatagagctgtttgtagtattctctgatggtagtttgtatttctgtgggatcggtggtgatatcccttttatcattttttattgcgtctatttgattcttctctctttttatctttattagtcttgctagcggtctatcaattttgttgatccgttcaaaaaaccagctcctggattcattaattttttgaagggtttttaatgtctctatttcctttagttgtgctctgattttggttatttcttgccttctgctagcttttgaatgtgtttgctcttgcttttctagttctcttaattgtgatgttagggtgtcaattttggatctttcctgctttatcttgtgggcatttagggctataaatttccctctacatgctgctttgaatgcatcccagagattctggtattttgtgtctttgttctcgttggtttcaaagaacatctttatttctgccttcagttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatttgtgggagtttaagtctctttgtaggtcactcaggacttgctttatgaatctgggtgctcctgtattgggtgcatatatatttaggatagttagctcttcttgttgaattgatccctttaccattatgtaatggccttctttgtgtcttttgatctttgttggttaaaagtctgttttatcagagactaggattgcaacccctgcttttttttgttttccatttgcttggtagatgttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaaggtaatattgttatgtgtgaatttgatcctgtcattatgttagctcgttattttgctcgttagttgatacagtttcttcctagtctcaatggtctttacattttggcaatggatggtacaggttgttcctttccatgtttagtgcttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgcttgtttctttttattcttttttctctaaacttcccttctcgcttcatttcattcacttcatcttccatcactgataccctttcttccagttgatcgcatcagctcctgaggcttctgcattcttcacgtagttcttgagccttggttttcagctccatcagctcctttaagcacttctcagtattggttattctagttatacattcttctaaacttttttcaaagttttcaacttctttgcctttggtttgaatttcctcccgtagctcggaataatttgatcgtgtgaagccttctctcagctcgtcaaagtcattctccgtccaactttgttccgttgctcgtgaggaactgcgttcctttggaggaggagaggcactctgctttttagagtttccagtttttctgctctgttttttccccatctttgtggttttatctactttttgtctttgttgatggtgatgtacagatgggtttttggtgtggatgtcctttctgtttgttagttttccttctaacagacaggaccgtaagcttcaggtctgttggagtacccggccgtgtgaggtatcagtctgcccctgctggaggctgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggatactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcactgccgccttgcagtttgatctcagactgctgtgctagcaatcagccagactccgtgggcgtaggaccctccgaaccacgtgcgggatataatctcgtggtgcgccattttttaagcccgtcggaaaagcgcaggattcgggtgggagtgacccgattttccatgtgccgtctgtcacccttttctttgactaggagagggaactccctgaccccttgcacttcccgagtgaggcaatgcctcgccctgcttcggctctcacatggtgcgcgcacccacttacctgcgcccagtgtctggcactccctagtgagatgaacccggtacctcgactggaaatgcagaaatcacccatcttctgcgttgctcactctgggagctgtagaccggagctgttcctattcagccatcttggctcctcccctcttgttttgtttttagacagagtttcgctctgtcgcccaggctggagtgcagtggcacgatctcggctcactgcaaccttcacctcctgggttcaggcgattattctgcctcagcctcccgaggagctgggattacaggcccgcaccaccacacccagctaatttttgtatttttagtagagacggggtttcaccatattggctacgctagtttcaaactcctgacctcaagtgatcctgacctcaagcaatctacccgcttcggcctcccagagtgctgggattgcaggcgtgagccaccctgcccggcaggaaagatacttttttagaaagtatgttttaccttaaaaacaacatatatataatcaatttttaaaacttaagtgattataattttttttcttaaatattgtaatatacatgcaaaggcc

SEQ ID NO: 643 - DNA, 14210 bp, Homo sapiens
aaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaatac

SEQ ID NO: 644 - DNA, 29385 bp, Homo sapiens
ctaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaa
